United States Patent 12,746,261 (PROBIOTIC BACILLUS COMPOSITIONS AND METHODS OF USE) - sequence listing, part 8

SEQ ID NO: 10 - DNA, 4084681 bp, Bacillus amyloliquefaciens (residues 2,042,342-4,084,681 of 4,084,681)
aagagcttgttttccgactttcagcccttgttcggcccgtttttggttgacgaatatccacgcgtaaatttctttaatgttgcgtttcatttcttccatacccactaatgtgttcatttctttttcaatttctttcagaatgctgtgcttggcttcatttttttgcagggcggcctgatattccgcctcagcttctgcatttgtcagcacttgcttttggccattaagaatgatgttaatttgtccgttatttttataggttacagcgcgctccaacatgctcacctctctgttctctctttatcttactcatgatgaagcggttctgtgacatccgcctatcatcatgaggcccgttttcctctttatctgtcactttttccgttctcttcgggaatgatgttgaatcctgcgctttcccgagaaatatttttcatttcttattgtattcagcaaaaacgggaggacaaaccatttatttttattttccgggaaatgttgggtgtatttctcatttttttcatgaatgacagccgtacaagcaccttttgaatatcatcatatgctgtaatgaggtgatggagaatggttaaaatttttatagaccccggtcatggcggaactgattcaggtgcaaccggaaacggacttcaggaaaaagcggtcacgctggagatcgcactggctttgcgcacgattctgacgaatgagtatgaaggagtttctgtcacgatgagcaggacaagcgataagacggtcagcctgacggaaagaacggatgccgccaacagctggggcgcagattattttttatccattcatattaactcaggaggcggaaccggattcgaaagctatatttaccccggtgtcggagcgccgacctcgacttaccaatcagccgtccacacgcaagtaattcaagcatcgggttttaatgaccgcggaaaaaaaacagccaacttccatgtgctgcgggagacaaggatgccggcgattttgacggagaatggttttgttgatacgtcagctgatgcaaacaaactgaaaacagccagttttattgaaagccttgcaagaggacatgccaagggcttggagcaagctttcggtctaaaaaaaaaggctgacttatataaagtgcaaatcggcgcattcaacgtgaaagcaaatgctgatgcgcttgccgccgatgcggtgtctaaaggttttgacgcgattgtgcttccaaaaggcggcttatttaaagtgcagatcggcgcattctctttcagagattatgctgaagcgttggcagcgcgggccgaaaaagccggatttgatgccttcattgtgcaagactaaatgaaaaaacccctgctctccctttttgggacgaacgggggttttttgttattgaagtatatcggcgacaaaccgagaccaagcttcaagacgatgatacacattttcctctttcagttcgctcagtttcatccagcgcccggcgatttgatctttttctttcacttcgacttgtgctgcaggcgctaactggagcgcagaaaggatgccgatatgcaccttccctacatcgttttcatcatcattgatcaggccgagtgtgacaatgttttgtttgtcctcctcgcgaatgtacaattcttccgccagctcccggtcggtgttctgtttcagcacttccaaaaatgaagccgccccttccatagggttcatgtgtccgccgaagccgagagaaagcttattatggaggcgcgattcccctccgcccgcgagccgttcatacacaaatacctcatcatcgcggcggatgacgacatacggaatcggctgtttaaatcgcgggtcctcttccgcgtcgcctcttctgatttcaaaaaaatgcgcctcaatttgagccataatttttatgatacgttcatcctcgctgttgactccctgaaatgtcagcatttcgttttgaaagacgtcactccgcggtgcagccaagatgatttcatccattttattcatgcccgttcctcctgtcttacctctccactcaagccaaaagagcagatattatatctgctcttcatcttggccaaaataaaaatcttcgtccttaatcggttctaccgtcgcctttttgtagccgttccctttcatggagaagaaatcatgtgattttgttttggtgtttaatccgtttaatacaatcggattaatatcctcttcttcaaagtaaggatcgaaccctaagttcatcaaagctttattggcgttatagcggatgaatttctttacgtcatgagacagcccgacttggtcgtagagatcctctgtatattcaagctcattgtgataaagctcttctaaaagctcaaccgcaaattcgcgaagttccgcttttttcgcttctgtttgtttattgaatatttcctgggccagcagtccgacatatacaccgtggatcgcttcatcacgaagaatcaggttgatgatctcaccgctttgcatcagttttccctgtccgtaaaaatataacggataatagaaaccgctgtaaaaaaggaagctttccagatagacagaagcaaccatcgctttgaacagtgaaatttcatcatctttttgaatggctttgtaaagcccgacaatcatttgcgcttttttctgcagatatttattctgctttacccattcaaatacttcgttgatcgtttcagtcggagcaagcgtcataaaaatatttgaatatgattttgcgtgcaccgcgttttccatcatcgccatgaaattaagaaccgcttttcgctgatggccttcgacgtgctcggccacaatcggcatgcctgtgttcccctgctctgtatcaagcagtgtcaggccggcgagcaccttcatgtacgtatcctgctcatttttacccaaatacttccaagtaagaagatcgccgtttaatgcgatctcttccggaagccaaaactgctttacgttttggttgtagaacatttgggtgaaatcatcttcatgctttgaccagtttgctgcgtcataaatttttgtcactgttaactctcctttaatcaaacgacacaagaaagacagctgtcctgcccggtatctttcgttcttgcatagtaaatggttttgatgcctctatggtgggcatacagatcaatacggttcagatcacgagttgtcatcgtatctttcaaaaacagggtaaagctgattccctgatcgatatgctgctggattgtcgcgatcatatccaccactttgaacatgtccatatcataagcttctttgtagaagaaccagttattagacgctaaccccggcatcgggtaatacgtttttgaatttccgtatgttctttcttcgatccgttccatgatcggcataacggacgccgtgctggattggacgtaggaaatggagcctgtcggcgcgatgcacagtctgtagctgtggtacatgccgttttcggcgacaaacgccttcagctctttccagtcttcgattgtcgggatgtgcatgccttcaaagagcgcagcgattttttcgtatgccggtgagaactctttttcgatgtatttattgaaatattctcccgttgcataagtggagccttcgtaatgctcaaacgtttcgcctttttctttcgcaagctcagctgaacgctggatggaataaaagttcaccatcataaagaacgtattcgcaaaatctcttgcttccgggctttcataagcgatgccgttttgggccaggtagccgtgaaggttcatggcgcctaaaccgatcgacttcatcgctttgttcgcgcgtctgactgccggcgcgttgcggatatccgtcgtctcagatacatgagtcagggaatccgtcgcgagtttcaccgtgcgctcaatcgatttatgtttcatgacattcaaaatatttaatgaaccaaggttgcaggaaatgtccaggccgatttcgtcttcctcgtcataatctgtgtaagccgaaacctgtgacgcctgaagcacttcagagcaaaggttcgagaatttcacttttgatacgtggttattcgcatgctctttgtttacgttgtcctggaacataatgtacggataacctgactcagaacggagaacggcaagcttttcaagcaatttgcgcgcattcactttttcttttttgacacgcgggttgtcaacaagctcctcatacatcgccgtcatgtccatctcatccatatgctggccgtattctttataaatcgtgtgcggatagaatacataagccgctttgtcctcacgtgcaagctcaacgaacttatccggaatgacgacaccgatagaaagcgttttgacgcgcacatcttcatccgcagaaatctttttcgtatcaagaaagtcattgatatcgcggtggaaaatgtttaagtacgccgcgccagagccttgtctttggcccatttggtcagcgtaacggaacgcgttatcaagaagcttcatgacgcctacaacaccttttgtggcgttttcaacatctttaatcgcttcacctttcgcgcggagcttggacaggttaagagaaacaccgccgcccagtttagaaagctgcatggaaatatcgatcgcccgtgaaatatcgtttaaggaatcattgacttcgagcaagaaacagctcaccagttctccgcggcgttttctgccggcattcaaaaatgtcggtgtgctcggctgatattcctgattgatcatcagattcacatattcttttgctttctcagtgtcgccatttgcgaagaacagcgcaacaattgagatccggtcctcataacgctcgaggatttttttcttgtcattcgttttcaaagcatagtcattatagaatttaaacgcactcatgaaggaaggaaaacgaaacttcttagcgtaagctgtcttaaacacttctttaatgtcttcaaaagaataaaggcttaagaattcctcttcgtagtattggttttcaatcaaataatccagcttctcttttaaatcgtgaaagaaaactgtgttttgattgatatagtctacaaaatagctatgtacagcctctttatctttatcaaactggaattttccatcttgttggatcatgatttcgttatttaactggatccattttggcacttgattttgtgacaactctttctacctcctgagtaaacaattcaacgtctttagatgtgccgctgagttcaaatttgtgcaagatcggcacctgatattgtctagagatggtatcggcgctttttgcaaagttatcgccccatactttgttgccgctcgcagcgactcctaataagagatgggcgtatttttcgagaaatgattgtgttgatgccggtacctgaccgaagtttgtcgtgtaggtgaccaaaacaaacggagtgtccacgtggtccatttcgtccaccttgcggatcagctgaaagtctgttttattcacaaaacgctgaacattccctgtctttgaatcaaatatgatttgaaccatccttatcacgacctatcaaaaataatgaatctcttaacactatatatagtatactaacctctcagaaaaacacaacatattgagatcgatttataaaaaattcatatttttgaaagagcggactttggctccggcccgattaacgcccaaaaaagagagcagaacgagaatcatctctcatcctactcaaggtgtcatgtgtaagccgatgtctatcataacatgaaaaaaaactgcttagtagtctagacttttattcttattttttgtaagaatcacattttttttcgctttcaacggtttcttcaatctctacatcagcaccgatttctttcagtacggctttcagagcgcttgtgatggaagcctccctgatcagttctttgccgtcaacgatgatgctggttccatattcatagcaggaatcatcttcacaagtttcttcccaatggttgattatcaccttgtgtttcaatcgtctcaccctctgcatgatcaatgtcagtacttagtgtagcttgtgcggcccgctttgtaaattcgaacgcttgtgaaatttattcaagctcatccagcgccgtttcttttttcagttcgattttattcgttttttcatcatagcggtatatttttagataaccgccctcgacaatgccgaaacgattatgttccagctgcaccatgccttctgtctgcgattcggcatccgccaagccgccgtcatcatccgtcaccaccgtctcgtgattgctgcaagctccaaacagcaaaaaaacagcgatccaaacgagcgtaatcctgattcttctcagttcattttcactttcgaacacgattttccgaacccccttttatctttccgatatacggcctgcaatatacagacgcgcatagaaaaagaccattgttcatggtctttgtcaaaaagtctattcaagctcaagctggacgtttttttgcggggcgaacgtggagatggcatgtttataaataagctgctgcttcccctccgtttcgagcaaaacggtaaagttgtcaaagccttttacctggccgcgaagctgaaagccgttgagtaaaaacaccgtgacgaacgtattgtcttttcggatttgattcaaaaactgatcttgaatattaatcggtttcatgtttcgtcctccttggttctcaatacaatactgtttcgattaaatttccagttttcctgctatgcactcgaaaatttccttttttttctgctcaatatcaacaggcggcgtcatatctgtccatgaaacgggcattttattgcgaaaccaggtcagctggcgtttcgcatatcgccttgaattttgttttaattgctccacggcctgaggaagcggcacttttccatcaagatattcatacagctctttatagccgatcgcctgaatcgattggctgtcccggatattcatatcatacagccgctttacttcgtcaagaaggccggtttccagcatcaggtcaacgcgctcgttaatccggccgtacagtacttctctgtccattgtaagaccgataagaaccgcattgtaaagcagctcccgtttttgggttttaagatgctctgacattgtttttcccgatacatgcaggatttcgagcgcgcggatgactcttcgcgtattgttttgatgaatggctgccgccgcttccgggtcggctgccgcaagcttggcatgaagcgcttccgccccttcttcagccgccagtttctccattcgctcccggaatacagggtcgccggagttttccgtgaacgtatagtcatacagcacggactgaatgtacagacccgtccccccgacaatcatcggcagctttcctctaccggcaatctcggtgatttttcccctcaccattttctgataatccgccgttgaaaaagtgtcggacggctccaaaatatcaatcaggtgatgcggcacgccttctgtctcttcttcggtgactttggccgttccgatgtccatccctttatatacctgcatggaatctccgctgatgatttccgcattcagcattttcgcgagtccgatgcttagttttgtttttccgactgccgtcggtccgacgagtatgacgacaggctgttttttatttttcaatatgtatcactctcttttataaatctccccctaattatagcattcatttcttcaggcacctatccattttgccctttttcctgagcgctaaacgtccgctaccacccgatcggctcgtttccgacaacctctctcgtttttcctttgagcgtatggcggtgcgttttccgtccttcctcccgcggatcgtaaacgacgccgccatgctggatccgaatcggctcattgtaggcggcaaaggtggtctctgaaagctcatggtaatgtgttccgtcaaccctcgggatggcagggccggaaatgccgtaatacctatgaaaatggccgttttcaaacgaggtgatgcccgtatagaaatgtgtatgctcatctgtattgctgccgttctccggctgcgaaaagccttcgatcatatggtagtgcccctgcactacatccgtaacagcccggtatgcgtgtgtgtgcggaggtttttttgaccaatcggactgatacaggcccacaaaagctcactcctttatttttttgataaatgcccaatcaaaaattggtgggctgaatactctgttatcatctcaaatttattcttggaggtacctaaattatgaatgaagaatacacatatgcagcagatagtgatatgagaccgtttggacggcccggatttgggtttggacggccgggcttcgggttcgggcggcccggattcggcttcggcttcgggcggccgggttttggatttggccggccttggtttggttatggattcggacggccgtttggtttttacggcggaccgttcttcggagggcttgtcggggggcttgtcggaagcgctttattcaatccgtacctgtacggaggttacggctacccttactatccgtattactactaagacaatcaaaaagggctcctttcaggggcctttttatataggcctaatgtcttgacttggcgggcaaagttcggatattattttattttactgccttaaacaaaaggcataaggattatgatgagagggggatttgatatgattctgggttatatcttcctcacaattgctattttatcagagtcaatcggcgcggccatgctgaaggtctcccgcggatttacgcggtttttgccgagcgcgcttgtagtggcaggctattcattggccttttatatgctttcacttacactgaatctcattccgctcagcttatcctatgcaacatggagcggagcgggaacggtgctcgcatccattatcggagcgaaatggtttcatgaaaaactggacaagcaggccgtcatcggacttgtattcttattggccggtgtcattctgatgaattggtagaaaggagaagcatgatatgaaaggattactctgcctggcattagccattgtatcagaagtgttcggaagcacgatgctgaagctgtcggacggttttacgcacttatggcccgctctcggcgtcattgccggaatcggagcctcttttatgtttttgagcttctctttgaaaagccttgatttatccgccgcatacgcgacatggtcaggtgtcggcacggctttaacggcaattgtcggcttttttgtttttaaggaagccatgacagctaaaatgatgatcgggcttatttttgtcatcacgggcgtcatcctgctgaaccgttccaagtctcaaaaagctaaaaaaaatcaaacggcccggagctgaccgtttgaactcgtcaagcgcgggcagcttttacttcaacctcaagctccatctccacgtttccttggaccgctcgtgaaatcatacatgaggactccgctttttgcgctaacttcctggcgagcgtaaagtccgtttcggctgcatccggctttaataatataaacgggcggtgaatgattttctggtacgtgaacacaccgttcgtgacgtctacaattccttcagattccatatgtagatcttctttatccaggccgcttctttccatcatcgccgcaagcgttataatataacaggtcgcggccgctccaagcagcatttcatcaggatttgtgccttctccgggtccgtccatttccttaggaatggacacagcggtttccagccggccgcttttaatatcgccgacgtcattgcgatttccgggccaatttgcttttaaataaaagtgatgttttgccaagggacaaacctccttttttttcagtttactcacctttcactggtttgtctttttttaagctcacgaatactcttgattgatcactctttttatcgtacggacaaaccggtaaaattcctccgtttttgtgaattccctttcgcggtaatcaaaattatcaaaaaacgcctcccgctgttctctgctgatctcaagctgtatactcagcccggtttgcgcctggttattgatattttcggtgtcaaccccggccagaccggtttttgaggttgccaattctgtaggaaatccgtttcgtttgagagctctcaccaattttttcgcccgcttccggtcgcttcctccgacaagagtatttttctcgtcgcctttataaccgtgaactgcgataacataatggtgctgcttaatgctttcgactgctgaaggctcatcgaacttggtgctcgtaatatgaagagtctggttatcatgcgcttttaatccctcaaacaggtaggttgaataatcatccctgaaagagcggacgatctcgctcaccccgccctcaattctccctccgtgcggggacatgatcaatacggggctcccctttctcttattgtacgatatatgataatcatcggggtcttcatgttcagccagatctttaaaatctgtgtatgtatcagaagaattcgagggatcagggtctgacgcataatgagcacatcttattagtaagaccattgctacgataatgatgacattaagtaaaattcttttcatcagctctccttctttgctcctttctgaaaaatgaaatattcattatatggatttttgtcaataggtcttatcttaacattctattaacattatcatcagtgaaaaacttcccggtttcgaaaaatcaatggattgtcacggttcaagcgctcaaatgccgggcatcagtgaaaaaaggttgagagagggcaaaaaaaaagggaggaacgcccgaattttcaggggcgggagattcacggccggaaacggacggcatcaagaatacgcttttagaaatgaatatccgcctcccgaagcaaatgcgcaggacagaatggagcccgtcaaaaaagttctcatctgcctttttgtacagcaaaatgccattacagcccgctcatcccctttttttatcataatggtccgttttgaaacggagccgtctctttattcatatatataatatcaatcggaagctgtttttccaaggaatgtctcaatatgatgttcatgtatatactaccttccgccggcttcattacaaaacgaacaaacgttccgtttcaactcgatttcttctcctgaaaaagccgcaagtaaccagcgctcctgaaggacaaacaaactgaccgaacttacggcctgttcatatggtatagagagaatcgccagaatgggaggaaaagtatatatgtttggttactcaatggtacaaatggtgcggtcaaatgctcataagctggactggccgctcagagaaaacgtattacagttatataaacctttcaaatggacaccttgctttttacacaattttttcgaaaaaaaggtgaaaaacagaaagaaaatgtcagtcatcattgaatttgaagagggctgccatgaatccggttttcacagcacaggacaggtcttatcaaaagaaaaacgctgcaccataaaaaagcagtttcaaacaatcaattgctgcagcgccgaagtcacgccgtccgcccttcacatgcttctttcgcaatgccgggatatccgtaaaatctatttaaaccgtgaagtaaaagctctccttgatacagcagctgaatcgtctcatgcaaaagaagtgacccgtaacggcaccgtattaacaggaaaaggcgtaaccgtcgccgttattgataccggaatctatcagcatcctgatttagaaggcaggattatcggctttgcggactttgtcaaccaaaagacagaaccgtatgatgacaacggacacggcacccattgcgccggtgatatcgcaagcagcggcgcttcatcttcgggtaaatatcaggggccggcgccggaagccgatctgatcggagtcaaggttttaaacaaatcaggatcaggaaccttggctgatatcattgaaggtgtggaatggtgcatacaatataataaagaacacacaaagaatccgatcagaatcatcagcatgtcgctgggcggagatgcgctcaaatatgataaagaaacggacgacccgctcgtcaaggccgttgaagaggcatggaatgaaggaatcgtcgtctgcgtcgccgcgggcaactccggtccggaagctcaaacgatttcaagccccggtgtcagcgagaaggtcatcacggtaggcgcctatgatgacaatgatacagccagcaatgaggacgatacggtcgcttctttctcaagccgcggcccgacggtgtacggaaaagagaagcctgacattcttgcgcccggggtcgatatcgtatctcttcgttctccgcgttcatatcttgacaaattacagaaatcaaaccgagtaggctccttgtatttcagtctgtcgggcacgtccatggccactccgatctgtgcgggcatcgctgccttaatccttcagcaaaacccgcagctttcgcctgacgaagtgaaaacattgatcagacaaagtccggatcaatggacaaatgaagatccgaacatttacggagcgggcgcagtgaacgccgaaaacgccgtgccgaaagagtaacctttttatcatgagaacggggtcgtctgcaccggcagatgactccgtttttcaggtgaatagatgaaacatttataatgaaggaactcggaacaggtcagaaccggctgtcagaaaaaaagatcaacgcaaggcagtgtatttctaaaaaaatagggaataagtatggtgtagataaaaggaggaatcacaatggcacttacaaacaccgaattgtctgaatggctgcaaaaacagatcggacaaacgcttgatatcagaaaaggagagctgacagacagccgaaacgagatttctgatatggatcagatcatgcttcaccttgatgacgttctcgtccgccggacaaaccatcccgatgactatgtagcggatgaagaactcgtcttaaaagggcacggcacaacctatacggaggaaggaaatgtcccgcttccccaagatgcgtatgaaattcctctgctcggcgacattaccatccaacaggagcaagacggattaaaggtacatacagatcgggccgtgtatacaatcgggacccggaaagagcaataaaaagaaaaaacgccgtgaaacagcggcgttttttattggtttttttcttcagaatatccgtggaacatcgtgaatgcgcaaagcataatgcctaaaataatgataatcgggagccagatcacggcaaacttataatccggttcggcaaaagcgcctatgaccgccccaaagcaatacagaaccaaggcaagcgcgcgcaatacagcatctctcgtaaactgcttccgcttgtccgctttgtaaaaccttgcggtgagatcttcaaaaaaattagcgagcgttcccgttaatacggtcgtggaaatccccgctacaccaagttttctcgcggctgtcgtctgcattcccattgcgaagctgagcagcataatcagcacataaacagaaatggcgtctgcaaaaaagcaggagaacaaagcaaacagcagcaaaacagctccttcaatagctaaagcggcagttaccgcaggggccagaatgatttctttttattgcccacaagcagggccgcggcaataacgccggcaataaatccgattaacgaggttaacgatttgagtacggcaaggtgccatgagttgccgatcgccaggccgaacagaacgatgttccccgtcatattggcggtaaagatatgtcccaggcttaaataaccgatcacatccacaattcccgctgttaaacaaagaagtaaaagtgcaatatttcggtatgtagtcactgtcaatgtgatccaatcctttctcatgctgattccaacatataagtttactctttgccatttcatatgtccagccggcgtgccgctttttcaaagcataaaaaaactccggcgaaccggagaagttactgaacgataaataatactctcgtgccgtcggaatagccgctcatttgatttccaacccatgaaccggccccgcggttatccgatggggttacatatctgatatcagcccccgccccgccttctgtgcagactgccatgggccattcatcacggtcaaacccgggctttgtcggaattcctttcaatgattctttccttctgttctccgctccgccccgatcaattgtacaaatctcagaatgacctgccgaaatggcgtcttttatatgatttcccgtctccggatattttgacagcgggaaatacagcacctgatcgtatcgggatgcagcatgagcagcactgtccgaatggatgccggcgcccgtaaggccgaactgaagagagatcaccaaaagcagacttgccgcccatttcataaacgcattcattcacatcctccttaagaagttgatatgaagcgtaaatatgtatattagccggatttaacacacatgatgaaatggcaaaaaaagtttgctgttttgttgataatcaacgaaaatggcggctttacgatttgtctattgaaccggcttctttttccttatatattttagacatacttatgagccgttgtgatcagtgtcttcggcagataaaaggaggaatgccgtccggtcggcaggcaccggctgttggttatgtcttttcaaaaacatgaaggcggggaaatccagatggaaaaaacaatgtttcacccacactcacccgagtttcacgaagacccttttgcggttttaagcagattcagagagcaggaccccatacataaattcgaactgcagcgtttcggaggcacctttccggcatggctcatcacgcgttatgatgattgtatggcgtttttaaaagacggcagaattacgagagatgtaaaacgggttatgccgaaggagctgatcgcgaagctgaatgtcagcgaagatatcgattttgtctcagagcatatgctggcaaaagaccctccggatcattcacgtcttcgatctttggtgcatcagggttcactccccggatgattgagcagcttcgcaccgggatagagcagatcacagaagagctgctggatgaaatggaaacaaaagcagaccctgatatcatgaaagatttcgcggcaccgcttccgtttatcgtcatttccgagctgctcggaattccgaaagaggaccgcgccaaatttcaagtatggacaaacgcgatggtcgacacgtcagagagcggacaagatgcgaccaaccaggctctcaaagaatttaaacaatatatgaaaacactgatcgaagaaaaaagaaaacatcccgctgaagatctgacaagcaagcttatttacgctgaagaggacggccaaaagctgagtgaatcagagctgtattccatgctgtttttgttagtcgttgccgggcttgaaacaacggttaaccttctcggctccggcaccctggcgcttcttctgcacaaagaccagatggagaagataaagcgacagcccgaaaatatccagacggcggtcgaagagcttttgcgttacacctctcccgtcatcatgatggcgaatcgatgggcgattgaagatttcacctataaagatgtttctattaaaaaaggcgatatgatatttatcggcatcggttcagccaatcgggacccggaatatttcgatgatcctgatacattaaatatagcgagaacaccgaaccgtcatatctcttttggattcggcattcatttttgtctcggggctccgctcgcccggatggaagcatccattgcctttacttcgcttttaaaacggtttccgaatatagagctgaaaggcgcgcacgaggatgtaaagtggagaaaaaacgtgtttttgagagggcttgaaacattgcctgtcagattttaatatcgccccctgtttatcgggggttttttaatgtcttataaacaggaaatcaatataacagtgaatatttagtacatagtgtatttagttctattgtaaaaaaagcggccggattgctccggccgttctctattaccgttttaccaactcatttgtttcgtccagcttttttttgaaagatttaaggaaatttgcgcttatcgttcctttgtttgcgtacagtttttcgcagaatgccttaatggcgttttgcggctttggttccgacagcattgtgacatgattggaagagtggacgtccagcaggtgaaagtgtttcatctggtgttcccattctttccaatacgcatcatggtctaacggaatttgttcttcctctgctgtcagataacgttcaaaatctccgagaaacaaaccgcttttattacggaagtagtagcattgcagcgcttccggatgaggcagcggcttcatgtcatactcttccattccgtaagcgagctgcgtcttcatcatttgctccagctgcatccggatcgcttcttcggattttggcagaccgcgctttttggcaaggccgatcaattctttcaatacttcttcttcctcagcctggacggtaatgtcttctctgctgattaatgcctcttcaaggttttcaggcttaagatatgccgtaagcatcgtattgatcgtttgcagcatgactgacttaacagatggttttctctctttccatttttcactgtacggggtgtcgatcatgacggcgctttttactgtatgaccttcctcctgcaagaggcgcgcggtttcataagcaagcatcccgcccaaggaatatccgccgaggtcataagggcctttcggctgtaccgcttggatgattctcatataagaagcggccgtctcttcgattccttgcagcggctctttccctgtcaaacctcttgcctggatgccgtaaaaaggacgctgactctttttggcgaatggctggtatgcttcaacgcctcctgttccgccgtgaaaccaaaaaacaggacggcctttttctctttcattcagcttgacgagttcgggaaaattccggcccgcttcatgcggctggttcgtttttaacagcatgccgatctcctgaagagtgctgcatttctgaagagcttccagactgatgcggctgtctccgtcctcaagttttttcagcagctgaatagaggagattgaatcaaagccgtattcagtcagcggcttattttgatcaatttccgctgccttcatccccaaaatgtcagccacaatgtcagctgcgctctcgcggcggagctgagggtcctgggaaaccggcgcaagggtgatgtcttctggctgaccgccattccaatacttgtggtgttcaaaaggatatgtcggaagcggcactctttgaacagatttgccttggtggagtctgtcccacggtatatccgctcctttcacccagcaaaatgcaagcttttccagattgttttcagccaacagcgtctccgtgacgactgtaccgagagtcccttccagtaaaacgccgatatctcctgatccagtctgctgactgcctgtaaagaagcttttcattccattgctttcttcggaaaatgctctgtactctttcagtttttccagcaattcatcttgattgcgggcaacgagtgccaagcggcagttcatcgcctcacggccggtctgaagcgtataagcaatatcccgcagtgacggagtatctccagtttgcacaaaatcagccagctgacctgcggccgccttaagacgcccttcgctcttagcagaaagcacgataagctgcgggtcatgcgcagattctttgtctttatggctcggactgtactgttccaagacgacatgcgcattcatgccgccgaagccatagctgttaattgcggcccggcgcgggatcggtctgcccgtatggtcggtgagctgtgaccattcctgattgtcttcggtgaaacggaagcggcttttctgaataaccatttgctcatttgcagctgtaaatccgggaatgcccgggatggtatgatgcttcatggccatcgctacttttataagggcggccagtccggaagcgagttcgccgtgcccgatgcaaggtttcacggtgctgatataacaaggcgcgctttcctcttgatttgcagactcgccgtaacccgctttgattgcattaaactccagcgcatctgccatttcggaggcaatgccgtgcgcttcaatataagtgacggtttgcggatcaacatcggtgtcttcgtacgcttttttcatcgcggccttcattcccgccggattcggtgcgtgaagcgacatgcctttaccgccgtgagacactcctgttcctttaatgaccatgtgaatatgatcgccgtcttcaattgccgcctcaagcggtttgatgatgataacgcccgccccttcgcttctgacaaagccatcggcatctttttggaacgatttcgcccggccgtttttgcttaaatatcccatcgagtcaaaaccgataaaacctttcggcgattgcagaatattggcggcgcccacgacagcctgctcacattcgttatgatggattgattgaaccgccctgtgcaatgccaccagcgttgacgtgcaggcagcctcgtaatattcactcggtccttgtaaattcaaggcatatgatatcctgttcggaatgatggacggaatggctgttccattgttcggatcgctgttgcccgcggcaacgaaaacgcctgtcggtctgcttgataatgccttatttgtcaggcccgcatcctccattgccttccatgtatgcatcaaaagcagaaactgctccggccccatttgtgatgcctctttaggagaaattccgaaaaagagcgggtcaaattcgccgacaccgtcaataaaaccgccccatctgagactcgtgtcattctcatcgccggcgtaacggcgccagtcccagcggtccgccggaatttcggtaatacagtgatccccgtttacgatgtgtccccaaaaagactggatatccggggattgcggaaactgagctgacataccgataatcgcgattccttgcttgacatcggcgttttcacaaggcgtatgctgtttcttcggtaaagtgcgctcttctgtttccgtgaccccggcctcttctgaatgcctatgatcggcaagcaattgagaaaacttgctctcatatgctgacgcgaagtggcgggtcagctcctccgccgtcggatactcgaaaaacaatgttggattcacatcgatgtccgcctcttggccgatctcttttgtcagcccgatcagactcgctgaatcaagtcccaattccatgatattcgcgtcagaacgaagagatgacgcgggttcatccatcatcttggcgagcttgccaaggacgtagctgcggatatcatctgtcagactgccggcagaaatcggtgctcccgcattcttaacagccgttcgggccggctgattcatctgttcggttttcgggcggaaccgtttcagggcatagccttcaaaacgcatcaccacttccgatcggctgctgatgacatctgcgttaatcagaatcatttcccccgtttgtttagccagcttgatgtgcagccagcaatcggtaagattttccgggctgctgaaggtgacggaattaatgccgaacggcagatagctttccgtctctgtttggtccaataaagaaagcgaggccaagtaagcactgttggcgattaatggatttatggcataatgatgcgcttgttgtgagtcgctattgttcaggttcactttcgctaaaacggcatcagtgcctttgtacagacgggtgatcgttttaaattcttctccccacacgacggttcccgttccatctccgtataactcatctatccggcccacttcccggtaagagcgctgaatggccgccagatctgcgtgctgcttttgaaacggatacgggctgcactcggcatacgccgctatgctccaatcaggagacgtgcggctgcggtgcattatgctcagttcaaatccatccccgttttgtttcgattctgttttcagctcgatgtgatcgcctttttttacggtaatggggctgacgtaattcagttttttaatatgtcctccttccgcttcaggaaaaaggtcacaaaaatgatcgactgccagactgttatatgtagcgccgacgagtaccggttctccgccgaattgatgccctttcacgtatgggtcgtcatcactgtataccgcctgaacgccggcagcgttttctgattcaccgaaatgaaaagaagtcccgtggtcaaaagcgtaggccggcagatgaacggcgtgctcttgctgcaactgatcaaacgtgatattctctcctttttcccattgccgcgcacgccggccgatatcagaatcggagaaattgagattccgctgatccatgcggtaagcggccagtttttccagcagttcctgaacggaagcagccgtaaatgccgcccgatactccggatgatgcgttcttttttgcagcgcagatgcgatggcggccggatgaagagatggcgtcttttctaaaaaggccgccagtctctcaagataggcttcaaaactccattttgttttcgctgacacagggaaaatatattcctcatcgccgtgacgggcctgatcggaattcgggctgatatattcttctacgatgagatttgcatatgccccgcctgccccgaaggaattgatcatgcttctccgcggtacgatgtctcccgtctcggcatccttcagacgctcccaatactcggttttctcctgcaggtaaaaggccgtttgttcaagcgcgatattcggattttgcggttttgcgttaatggtcggaactaatgtttcccgctccatttgcagcagcactttcgcgagctgggacatcccggaggccgcctctaaatggccgagatttgacttgacggatccaagcgcgcaaaatcgttttttatcggtatattgcgagaacgcgttcgtcagggcaatgacctcaatcggatctcccaatacagagccgtttgccgctgattcaacataactgattgtttccggattgattccggctttgtcaatggaagccgccatgagcttcgcctgctgtttcggatccggagccgtgtacatctgccttccgccgctatggcacaacgcgctgcttttaatgaccccgtaaatatggtctttgtcggcaaccgctttggagagcggcttcaagagcaccgcaccgactccttctcccggcatcagccccgtgccggttccgaagcttttgctttcacttccctgttcaagcaaattcgcccgttcgagcgcatcatatttagacggttcaagcgtgagattgacccccccggcaatcgccatggaacagctgttaagcttcaggctttcacaggcgagatgaatggcgctcagtgagctggagcatgcggtcgtaacgcccatgctcgggcccgttaaattgaaaaagtgggaaatgcggttggcgatatgccaatcccctccgttagagctgagcgcagctttttccaatgacgggatattccagaaatattgattgtacatactgcccataaatacaccgattccgctgtctgattcctgccattcgtttactctctctaacgagtagccgccgttttcaaatgtttcccatacggtttcaaggcttagacggagctcaggtgtcatctccatcacatggtcttcccggatgtcaaacaagtgatggtcaaaagcgtcaatatgctgcagaaatccgccgtaccgtgttttgcgttcttcttttcgtgtttcttttgccatcgttttcagaagaccggacttccatctgttttccggagcttccgtaatacagctgtctccggcttttaaatgctcccacagctcatcgagggtttcagactcgggatagcggccgctgatgccgataatggcaatgtcgtcacgatctgagcgattatcggtgacggtttctgtttccggctttggcgcttttggctctttttgttcagtgataaatcgccgcgtttccgtgacaagcggcaccggttcattcattgcaggttccggatgctccgtttcaggaggcgcttgatcggctccgaatgcctgttgcagcttatccgggtaagtttccagcaaatactcggcaagttctttcgtattcgtgtgttcaaataagaccgttttcggcagctcgcccgtcaatgtttccagttcacggataaaattcacctgcaaaatggagtcgatgccgtatttttcaaagctggtttccggctgaatgcgctcgggagcaagctttatggacttggctaacgtttcttttatgaattgcaccgtccggtctgtgactgagaaagacggttctgtgaaatcagccggctctttggaagccgcaatttcttcaaccgccggcgcgtccggctgcttttgcctgatgacgccgtcgctttctgctgccacgatctgctggccgaggtgatgtgacgattccgccataaatgtaacgtaccgatatccctcgctttccagcgcagactgccacgcttcaggatacagcccagggcatccgggaatacgcagtttggcgtcttcatacagccaccagccttccaaaagaccgaatgtcagatgagaataaaccgaatggctgctgatctcatttaatagcaaaatcccattctttttaagcaccgctttggcattgcgaagtgtccgccgaatattttttgtcgcgtgaagcacatttgccgcaattaccgcgtcatatgcacccgcctctataccctgcaaagccgggggctcttccacattaaaccgcttataagtcaaatacggattgtcgggaccgtattctttttcagcatgcatgaaaaaggcctttgacagatcggtgtagcaatattctttcacatgatgtttgacctcttttaatcttttgaaaacggccgcgctcgtcccgcccgtccccgctccgatctctaatatccggatttccgcgttcgggtcttctttcaggcgttcttcaatgaaagccgtcaatgtgtcagcgagcacctcattaaagtagtctgccgtttcattgtttttatagattccttcaaccaattccattgaggaatcaggaaacagaacatcagtggcagaaactctgccggataaaatatccggcaaagctctgagagcggtctccactaaggtgatcatcgcccgtttgctgctgtccttgagtaaaggagctttcttttcatcccattcttgccacagaacgtccgcacgctctatcggacccgttaacacatacgtactgccagactgtttcaaaaagcctttttgcaccaagatggagatgctttcttccagccacctgccgtaaaacccctgcataacaggctgcgtttcgttttccgtaaaaaatccgacagatttcagctggcctgccaatagtttgtaaagaagatcttcagtgttttgcaaagccgtcccctccttaactcaattgttgtacatgtcttgttactttaggctgatagcttcgcagtttttgcatcgccgagccgtgatgttcagggtatacttctatcatttcttccggtttttcctccggctcttccgcctgtttcatcatgacgaactgattcaatgggccgccgagcaatcgttcaagcgccgccattgcttccggcgcttcaattgatccgactcccgcctgtttcatccgttcttgatattcggcagatgatacgattccgacactgccccagtagctccaattcatcactgccgccgaatacggccgaacttgagccaaatgagcggcaaaggcatctttgaaactgcacccggcagcataattgctttgtccggccgctcgcgcaaatgattgaacggatgagaagaacaaagcaaagtccagcggctcattttggaacacgagggccatattcacgctgacattgacttttgcagcgagcacgcttctcaaacggctttccggcatattcgccaggctctgatcctctaaaacaattgcggaatggatgattccgttaatttgcgggtgcgtgcgtttgatcgtttcatacgcccgtgtgagctcatccgggtttgccgcgtcagcttcaatataaatcggcgccggcccgaattggctgagtctgtcgattttttcctggatggcgctgttatgttttcgtctgccgatccaaacgactcgcgcctgatacgttttcacggcatattcgctccatgcttcgccgatgccccccgcgccgccaatgacgacataaacgccgcctttttggtaagcgggccggcttgacaccggctgctgtacagggatgaggcgctgtttgtaccagtgattgttgcggtacgcccatgtattgccttgctcatcaaacggcgctgagaacagctccgcctttgaaacatcttccggacatccggcatcaatcagccgtgtttgccagttcggatactcttttgcgagcgaaccgatcaaaccgtgaatgcctgcatgagccggatcaatgatgtccgccggctgtacggactgtgtttttattgtgactgcagtcaagctgattcgcttgcttccgtatcctaaagcaagcatcgctttaatcactctgtacatctggatgacgcccgcatcttgagctttcaccatgtcaccatcgctgtgaaaaggagcgatccatacgatatgcccgaaagaccctcttgctttcagttcagccgcaacagcctctatttcatcctccgggttgatatgaagccgtttcgcagaaggatgatgcaattgaaaagcctcgctttcctcatcccctgcgataaagacaacctcttccgtcttatatgccgggctttggtcacggaattccgcaagatcccataccggagccagaaggtttgctccatttaatgatgtttccggcgccggtccttccatcattctggaagaaatccctttaatcctgacacagacgcggcctgtctcatcgcataagtcaatgtccagccgctgtattttttcatccgttccccgggagctgacatacgcccacatgctggtcgtgcacgggctgaaaatgtccagttcctcaagggcgaacggcagtgacagctggttatcatctgcatgcagcttcagtccgattgtcgcttgcagagctgaatcaagcatacacgggtgaagaacgtattgatctgctgtttcttcgaggaaggaaggcagacggagctcagctaatgcttgattgcttccgatatgaatgtgctgaattccttgttgtccgggaccgtagtcaatgccgattttgttgaataagccgtaacactgttcagaagtcagcatgctgaggccgcattgagctttcagtgcgcctatatcacggtgcggagcctccccggcgccgagaatgccggcagccccctgacagtgtatctgcctgccgcttgcttctgtttgtgaatccgtgtaaatgtcatacacgatttcaccgtttcccctcgggttcaggctgatttgcgcttcaatcgggcggttttccgcttcgatcggccgaacccaaacgatgtttttcagacggatgacagacggaacttccttttgccctttgactgcctgagcaaccgccgccctggccatttccaagtaggcgacgcccggcatgaccggcttgcctttaataagatgatcggtgaaaatcgtctcttgtcccgtaaattcggatcggtaccgctgctctgttaaatccgatacattctcgtgtagcagcgggtgcagcacccgcgccgtcggcacagcttgcggtttttctgctttcggccggttgtccgtgatccagtaccgctctttcgcaaacgggtaagcaggaagactcatccgttggggcttgatatcagaatataagccgtcccatttgatatccgcgccctgcacccataattccgcaagcttgtcattctcccggcggcttatcagctcttcgatatccgcttcgccgtttgcgcctgccataatggatttcagcgggattttacccgcttttcctttataaatgcccgctttgtcataacgtcctttcgcacagctctttagcttgtcccgcagttcttcggccgaggaagcgataatggccgctctttcttccatcgcatcacgcccctgctgaagcgtgtaagcaacatcggcaagatccgcatccgtaaaagaagcttgcgccagctgctgcgcctgttcctgcagacgttcttcttctttggccgacagcacaaagatttgagggtgtgtgaaaacagctgtttttctttcttccttcgggatatattcttcaatgacgacatgggcgtttacgccgccgatgccgaaagaactgattcccgcacggcgcggcagatgattgccgttttcgtctttcaatgctgtccattctcttttttcctgtacgatgtaaaacggactgtctttcagtttgatatacgggttgatgacctcgctgtggaggctttttgcaagtgttttatgcttcatctgcatcagcactttgatcacacccgcgacaccggctgccagtgacaggtggccgatattggtttttgccgatcccaaaccgcagtgactcgcgtaaacggcgggatcgcctgttttttcgtacagcttttgaaaggcggatttcaggccgttgatttcgaccggatcgccaagctccgttccggttccgtgcgcttctatataagtgacggttctcggatcaatgcccgctttgtcataagccgttctgacgacttccgcctgggctttcggattcggtgtcgtcaaggagttcgcacgtccgccgtggttgaccgcgctgcctttaatgacgccgtaaatatgatcgcctgatttttccgcttctgacagctttttcaaaaacagaattccggcaccttcactgacggcaaatccgtccgccctgtcggagaacgttttgcatttcccttctttgctcagcgcacccgctttatcataagcgatgtggccttgcggtgtgacgacggtattcacgccgccggcgatcgccatctcgcagttcccgttttcaatggcgcatacggcgtgatgaatcgcgaccagcgagctggaacaagccgtgtcgatcggttcactcggcccgtgcagattgagcatatagctgacgcggttcggccctgctgacggactcatatttgcggctgacgcaccgccgatatccaggtcggaaaacagtgagccgtacccggtatttcccgtgccgatatacaggcctgttttcgtgccggaaaggcttttagtggaatatcccgcatcttctatcgccttccacgcatacatcattaacaagcgctgctggggatccatctgttcggcttccagcggtgaaattccgaagaacagcggatcaaattccgcaactccgtcaataaatccgccccactttacatttgttttgttggcttcgttaagcgggtcaccgtaatactcctgccagtcccagcgatccgccggcacctctgttatacaatcttttccctcttctaaattgcgccaatactcatcaatatttgcggccttcggaaacactccgctcatgccgacaatggcgatcggttccggtttatgttcagccgcagtctgaacatgctgtacggctgtttttgcaaatcgtttgttccctgccagtctgatgccgccatcatctgttacaccgcttttcttttcttctttcggctgtgtgctgccggcaaattgcgtttgatagtcttctgctaaatgatgcgccaaggcttgaatcgtcgcatattcaaaaaatacggtcggtgtcagatcaagctgataagtgtcattcagcttgttggcgaattccgtcagcgtaatggaatcaaatccgtattgattgaactccaattcgatatcgatttcttcaatgtttattttcagaagcccggaaacttcttttgccagcaattcctgaagtttggccgtcaggtctttcggcgcaggtgtttcttccgttttcttaatcggtgcaaaagcggatgcgggagtcttttgaagcagtttttcccgcattacggcgcggtttccttctataacgagcacgcttgttttccccgtgctccatgctttgtaaagagcttctattccggtttcagtgcgcatcggcgttacaccggttcttttttcggtgagcttcgccatttcttcattgacttgcattccgccgtctttccaaagcggccaattgattgacaatgtgtgaccgtggcggtacattgccgtaaccagcgcgttgcggtatgccgcatagctgtccataaatgcgtttgccgccgcataatccgcctgtcccgcattcccggtgacaccggaaatggatgagaaaacgatgaaaaagtccagcgctaaatgctcggttgcttcatcaaggttgacaaatccgtccgttttaggagccaatacactgtaaaactcttcggttgttttctttacgatatattgatctttcatcacacccgcgctatgaatgatgccgtgaaggccgccatattccgtttcaattgttttgaccaggtctgccgcagttagagcgtttgttacgtcagcctgtttgtattccgcttttgctccgagtgattcaagcgatttcagctgcatccgctgattctcgcttaatgcggaacggcctgtcaaaaccagcgtcggctctttgactttccgggcgatttctttcgcgaaaataaagccgaggccccggctcctccggtaatgagataaatccctccgtcgttccacggaatgcgtattttgccgccggacacggccgtttctttgacatctgcgctgtatcggatgccgtttttatatttgatatggctgtcatcagcccttgttttattttctctgatgatgtctgtgattctgccgttttccgctggttctatttcaatcagctgggttttcagttttttatgttccaggccggctgtttttagcagagctgaaatccctgagagcagctgatgcttatctgttttagagagaaccgtctggataaggacgtctccttccgtctcttccttcagcagtttttgcagcgtctccaatatccgtcctgtataatcacggaagcgcgccgccgctttcccgtgcagggaggtcatttcaatacattcagctcccgcggcttcaaccgcttgttttagtccggcgtctgtgtcacaaagcattacgatatgccgggcaaaaaccggttccgtttgagcagcagtttcatcgcttcgtgtccataccggctcaagcatgagcgtttccggagctttttcttttttctcaggttctttttcagccgttctgaatgacaaacctttcagccttacgcaaaccttgccattttcatcacaaatatcaagatcgcgtttttcaacatgtccggctttgtggtcttcagaaagtctggcgtaaacccacatctcggcagcgcatgcgctgaatacttcaagctcctgaaccgcaaacggaagcatcagttgttcatcatttgttccggttaatatgcttgatgcctgcaatgcagagtccattaagcccggatgcatgacatactcctgtaccgtgtccgcacaagccgcatcaagagacagtctgcccaatacgaaatcatcacctgtataaatcgctttgacaccccggaaagccgggccgtaatcaaaaccgattttgcggtacatatcgtacacttcatctgcagaaaacggtgtctcggcggattgtgatctcagtttttggagatcaatgaccggagcctttgcgtcagggcggactgatactgccccttggctgtaaacggacggctgatctgtttcccggccgcagtaaatgtcgaattgaacgtcatttgccgtttcgggaatgagacggatgttgacatgaaccggctcgtcttcaatggtaatcggccgcacccaaaccgtattcttaagctggacgcttccttgtccggccggaacttcagatgcctgttccattgctgcgcgcgccatttcaagatgtgccacacccggtaaaatcggcacgccttttacaacatgatccgcaaggtaaaattcttctcctgtatagattgagctgaaccgctgttctgcaaggtttgaagtatttctgtgcagaagcggatgaagcgcgtcttgttttccggcagatacagtgcttgttttttcgtgttttccggtgtgtttcgccgcccaatagcggtcttttgcaaaaggatacgacggcaggctcatgcgtttaggcggccggtctccatacagcttcgcccaatcgacgttcagccctttgacccataattcaagcagcttcgcgtatttgccgcgtgccatccatttttcaacggcttcttgaatttcttcatcttccgtcagcatttgcagcgtgcctttgtctattcttcctctgtacaaatccgcatgcttatctccagtgataaactgtgacagtttttcctgcagttcttctgcggatccggcaataaccgccaggcgttcttccatggcgtcccttccgatttggagagtatatgccatagaaacgaggctggaatgatcgtaccgtttttcagtaagcgcacgtttcagctgttttgcctgctctttcaggcgtttttcatttttggcggacagaacgaaaagacatgggtcgatatgagaatcatctgcttcctctctgtcttctggaatgtattcttcgatgacgacgtgggcatttacgcctccgatgccgaatgagctgatgcccgcgcggcgcggctgttcgtttccgcgttcgtccgtctgcgtcttccattccatcgtctcccgcaccagataaaacgggctgtcttcaagctgaatatacggatttaccgtctcacagtggagacttttgactaatgtgcgatgcttcatctgcagcaaaattttaataatgcccgctgctcccgcggcaagggataaatggccgatattcgttttgaccgaccctaagccgcaatagccggccgctttctcttttccgtctgcaaacgagctgaacgcttgtttcaggccgttaatttcaacgggatcccccaattctgttccggtgccgtgcgcttcgatataagagactgttttcggatcaatgcccgcttttttatatgcggctttaataacttccgcctgttgtttcgggttaggcgttgttaaagatgccgcacggccgccgtgattcaccgcgcttcctttaatgacgccgtaaatatggtccccatccgcctcagcggctttcagctttttgaggaaaaagagcccggctccttcaccatgggcaaaaccgtcagcctgatcggagaacgtcttgcatcttccttctttactcagcgcgcccgctttgtcaaagctgatatacacatccggaagaacaatcgtattgattcctcccgccaaagccatgtcgcacgtcccttcttcaattgaagaaacggcatggtgtatggcaacgagtgagcttgagcaggcggtatcaatcggctcgctcggcccgtgcagattgagcgtatagctgacacggttcggtccgacagacggacttgtattcgccgcggatgacccttcaatcgccgcatcggcattggctaaaagagaaccgtagccggtgtttccggtcccgataaacacacctgtctttgtgcctgagagactctttgacgcatatccggcatcttcaatcgctttccacgcatacgtcagcaagaggcgctgctgagggtccatttgctccgcttcccgcggtgaaatcccgaaaaacaacggatcaaattcagcaattccgtcaataaacccgccttggttgacgtttgttttattggcttcttttgcgggatccccgtaatagtcccgccagtcccagcggtctttcggaatctcggtcatgcagtctttgccttctttcaggttctgccagaaagcttcaatgtcttctgccatcgggaaaatcccgctgatgcctacgattgcgatcggttccggcccttggtcccgctgcactgtctgcggaagtgtctcaggcagagtgcggcgtcgcttaacggccgggcgcgtaatttgagtctcttttaccggtcttgccgattgaatcgtttttgtatttaccgcaaaccgtccggcaaattcctcttcgtattcactgattaaatgaacggcaaattcatggattgtcggatgatcaaagaaaatcgtcggcgttaacgtaagccggtacgttttgtttaactggttcgtaaactcagtcatcgagatagaatccagcccgtattttgtcatttcttcatgaggatcaattttgtcaatgtttacttttaacagcgaggccgtctgctgttttaacagatgcttcactttttcaagcaggctgtcagcatcaatgtcatgacgtacgccgatctctgcttccggatgatcattctctttgcggaaccgttttgctttcatgtgtttcacatctccttcaaaaaccgtcatccgggctgtcccgctcatcaagccttgatataaagccttgatgccggcatctgtgctgagcggtgcgattcccgcctgctgcatcagcatatcttccgtctgctttcctgcctgcattccgccttctttccataacggccagctgacagaaagcgtctttccgtatctttgtcctgcggcttgtaaagaacggcggtactcggcatacatctccataaaaacatttgcagacgcataatcagcctggccgacgcttccaagcacacctgataaggatgagaagacaataaagacatctaatttctcatgttgtgacgcttcatcaagatacacaaggcccttcactttcggagcgagaacgtgttggaattcctctgccgtcttcttcaccatgtagttgtcttttataatgccggcactgtgaacaatcccgtccagcttgccgtgccgtttacggatattgcggatcaatcggtatacttctgcttcgtccgtgacatcggtctgctcgtagaaaacagaagcgccggcagcacgtactgtttccagcatgtctttctgcttttctccgagagcggaccggccggttagtatgatgacggcgtcttttgtacggtttgcgatctcttttgcaaaaatcagacctaaacctccggcacctcctgtaatgagataaacgccttcgtctttccacggaatgtccggctccgcttgagaaatatccatctcttcccaatcagcggcaatgcgcttgccgttttcatatttcacatggacgctttcggcatgcatacggttttccgccgctttttccgcgatgccttcagcactttctttctcctcgacttcgatcatttgacagatcagcttggaatgttcaagacatgcggttttgaagaggccggtaatgcctgagaacacctgctgtaagcctgctgaccgcgtaacagcctgaaaaagaacgcggcccttcggcttgcttttcattatggttttgatatggccaaacagctgacccgcataagaatgataccgctctgcaatagatgcgggacgatcgtccaggataatgacgcgtgcatgttcaagctttgcttcgacagcttgtttaacggcttcatcgtactcacaaaggaaaatgatatgctcttcatacgaaggcgcatgatcggccggtgccgtctgctctttccagaccggttcagcgaacaatgtgtccgtacggctgaccgaaacgccggcacccgcgttttcttccatgatccgcgttgagaaacctctcatccgcacacaaagccagccgttattgtcatataaatcaatatctgctttttggataggatcgccggctttattgttcgcactgaatgtgacgtgcacccacatatcatcagcgcacggattcagaacgtccagctcctctaaagcaaacggcaatgcggctttgaatggttccccgctttctgccagcagcgctctcgtcacgttttgcaaatattcggcggcctgaagcgcaccgtccatcatactcggatgaaggatataatcagctttcgtatgggagagggattcaggaagcttcaatttagcaagcagccggtcttcgcctttgtatacaagctggacacctttatagccaggcccgtaatcagctccgatcattcctttgtaaaacgcttgagattcgattgttccctgcgtgcaccggcgcttcagctgctcaatatccgccgcttcctccggttccttccggatgatttcagcgatgccctgattataaagaggagcttcttcaccgatagaatcgttaccgccgtacattctgtattgaatctgtccgtccccttcttcataaagtccgatatggacacggacagcgtcctgatcgactatcaccgggcggacccatacgatattctttaagcgcaggccgagagaatcctctgttgccccgccgatgcttttctccgccgcggcccgtgccatctcaagggtgacggcagccggcacgatcgccattcctttaatgatatgctcggcaataaaatactcttttcccgtaaattccgaactgaaccgctgctcctgcaagacggatgtattctgatgtaccagcggatgcaaaaacttcgcatctgtttgcttcacagtttcttccggccagaagcgctcctctgcgaacgggtaggtcggcgcactgattcttcgcggcgcggaatcctgatacaataagccccaatcaacacgcgctccttcaatccagagcgccgcaagtgctttcagcttttcatcacgtgtctgacatgccgcaagctcttccatctcctgagccgacacttctctgcttctcactttttcgccccgtaagatgttttggtcattgccgttgatgaaatcctgcagctgacgcttcagatcgtgacgatcatgactgataaaaacggctctctcttccatcgcttcacgtccggtctgatacgtaaatgccagatcatgcaaggaaacatcgttttcggcttcatccagaaagccggataaacaagttgcataggcagtaagacgttgcttatttctcgctgacagcggaacgatataaggcggctgtccgtcatttgatccgctgatcgttttgttttcatactgttcaaaaatggcgtgtgcgtttgttcctccgagtccgaatgagcttaacgctgcccggtgcggcgtctctctctccggaagcgattttctcttatccgccacataaaacggcgaaccgctgaatttgatattcggattcggtgacgtgtaattaatggtaggcgccagctcccgatgatataaactcatggcgactttgatgcacccggccagacccgctgctgtatccaaatgcccgatattcgtttttacggagccgattccgcaatactgctcccggtccgtgtaacgtttatacacttgctgcagcgcggacatttcaatcggatcacccaatgtcgttcctgtgccgtgcgcttcgatataggaaatcgtctccgggtgaatattcgtgctgtctaaaacatgctggatgacgtcagtctgaccttttacactcggtgcgtaaaaaccgactttatccgctccgtcattgttcagaccgatgcctctgagcatggcgtatatgtgatctccgtcctgaacggcttgcgacgcctttttcagcagaatgacggcagctccttctccgcccgccataccgtcggctgaagcgtcaaatgccttgacatgcccgtcgcttgaaaaattcaatccgttttggtgcacatagccgatgcttgtcgctgcatgcagcgttgctccgccgacgagcgcgtattccgattctccgctcgtgatgcttttataggctgaataaagaccgactaatgatgatgagcaattggaatgaacgaaatagcttggcccttttaatccgagcttatgggaaaccatcgtcggaatcgtgccgctctgcgctaacacccatgagacatagccgtcaggagattcatggccttctgtcgttttttccggtaaaagcgaccgatacgaattattgcttgccgacatatatacgcttgtcttcggaatctctttggatacatatcccgcgtcctcgacggctttccaagaatgtagcagcagaagccgaagctgaggatccataaattctgcgtctttcggagaaatgtgaaagaactcagggtcaaagagatcttttccttctatcgtcgataatgccggcacatagtcgggattttcgatcaaatcttcaggtacgccggcttcccgaagttcttcttccgagtagaaccggacgctttcctttccttctcttaactgcttccaaaactcatgatgatttttcgcgccggggaactggcaggaaatccccactatcgccacactgtcgtcaaagtaagacggcaccccgttttgcggtgtttgttctctttctctctcatcttggcctgatgcctctgattcagccgcctgtttagtttcaacaataaatcggctgatcgcctgaatggtagagtgttcgaataaatccgtgacggtaaaatcgcattccagctcctgtttaatgcgttctgccgccgcaacagccaaaagcgagtcgcctcccacatcgaaaaagccgtcttcggttttgatgcccgccgtattcagcaggtcttcccatattgcggtcactttcgcttccgcttctgataacggcagtctgcccgtcttttcagaccggtgaacaattaccttgcgctgttttaggtctttgcggttcacttttccgctcggtgttaacggcagcgcatccagacggataaaatgggcaggcgccatataatccggcagactcgataaaagatggttgcggagcgctttttcatctgccgtatgaccggagcgggccgtataataagcaatcagctttttatgtccgttcttttcctgaacaacaaccgcctgatcaagaatgtccggatgttcgttcaatttcgtttcaatcgctcccaattcgatgcggaagccgcgaattttcacctgactgtcaatccggccagcatattctatatttccgtcaggcagccatctggccaaatcacctgtcttgtaaagcttttctccttcactaaacggattatcaataaatgatgccgccgtcagctcaggctgattgtaatagcctctggccagaccggcgccggccacgcaaagctcgccggccacaccgtcagggacggggctgagcttttcatcgacaatataaagccgtgtattttgaatcggtttcccgatcggcgtattcctgcttgtgatttccttttggccgcagctgtagtaagcggcataaatagatgtttccgtcgggccgtatatgttttcaattctggcatgtttgaagatggaaacggccttttttactaaatctttcggaaatgcctcaccggccaccatcacatatttcacagggccgtcttctgtaaatgccgtatgccgctttaccgtttccagaaatacattaaacacggcgggagcaaaattcagatgcgtgacctggtgggtttggatgtattccatacaaagctgcgggtttttttctgcaccaggcggcaaaatgacaagccgtccgtttccgataaaccagccgaataattcagaaatcgaaacgtcaaatacgtaattcgtttttaacaaataggcatcctcttgcgcgaccggatactcagcttccaaaaactgcagcgtattcatgatggccctgtgctcaaccatgacgcctttcggttttcccgtgcttccggacgtatatagaatataagcgagatgatgcggttttgaacgcggcgtcagttttgccccgctgacagaacgtccgctcttttcaatttccaccgtgctcacaccgccgacggccaactgttcaatcatgccgcgcgtatttgcttgcgttaatacgattgaaacgccgctgtcagtcaacacgtgcgccatccgttcgtttggaaaagccgggtccagcggcacatacgcgcctcccgcttttaaaatggcgaggatgccgatgaccatctcaaaagaacgctccgtacaaatgccgaccgggcattccggtgtgacgcccttttcttgcaggtacacggcgagcgccgtgcttcgttcatctaattcgcgatatgtaagactgttttcaccgtatgtgacggcttctctgtcagggtggcgtccggctttttccgcaaacacttcatgaatgcagcgctcattcggctgatgagatcggcttgcttcacgtttttgattgagcaggccggaacaggcttcaaaagcgatctccggatcagaaagcaccttttctgccagtttcatataatgctccgccatccgttcgatgaaagaagggctgtagacatccgggttgtacagaaattgcaggacggttcccgtttcttttttatagacttcaagcgcaagctcaaattcgccttcctgatgaatgtcttctatcatttcaatgccgagtgattgatatagttccgccagcttttccgctccttctgtccggaagaagttttgatagaaaaacgcggtttgaaaaacaggcgaaaccgcaggcgagcgttccgtcttcaattctttgacaagcgcgggaaacggatacgcggcatggtccagcccttctgccagtgtcagctgcagctccttcaaaaacgccgtaaaggatttggcgcccgtctccctgcttctgaccgcgatcatattaataaagtatccgatgacagattcaaattgagcctcagagcgccccatcgtcggcatgccgacgatgacatcttcctgattcgtatattgatagagcagccctttgaaaatagcgagatacacaacggattcattgacattatgtttttgggcgcacactttaatctgccggttcagttcatcaggaagcaagcgctgatacgcctgccctttgcaagtttgaaccgatgatctcggataatccgacggaagctcaagcaccggcagcggtccttccagctgctttttccaataagagagatgcgtttttcccgcttcgctttccagcagctctttttcccatttcacaaagtcatgataatctgcggcctgctgaaccatgacaggttctttgccttcacttgcttttacataagcgtccagcagcgccgacataaacgtcataagagagacgccgtcaaaaataatatggtgaatggtgattaacacaatcggctcccgcttcgcccgccggaatacatgaacacgcaggagcggcccggtttcaagcgcgaacggttcttttgctttttctttaataaacgaaagagcgtcacgcccgcttaattcagaaagatccatttcttcaatcggaaaatgccgatccgtatcttctatctgatacggaaggccgttttcctcttttatcacactggtcaaaatagggtgctggcgctgcacggacaaaagggcgtttttgaatgtctcgatatccagcttttgaaaacgaaagcataacggaatgttatatgcgctcatctccggaaacattttctgaagcatccacaaacctttctggccttcagaaagcggacgttttgcagttgtccgcttgaaagcctgaagcttttgttctacttcagcgatggtgagcgttcctgatctgtaggcatcgagaagttctttatgattcataagtcttactcccttctatgatgtcttgcactcttttaaaatctaatgtcccctcagagacctgtttcatcatggcgatgatctcctgatccgtgtactccttgttacccggagcggcggcttttgtttcagtttcttccgttcggtaaaacgttttgatcgtttctttgtgttctgtcaggtaatagctgatgacgtctccgagcgtggcatagctgtaaaataaagccggagtgacttcaatgccgtaatgactcgacaaaagagcggcaaatttggctaaatagatggaatcaaatccgaattccgcccagtttttatgcaggacgagtttatctttagatattttcagcagactgtgtatcagctctttcaaatccgcttcgagccgtttttccgtgctttcttccgggatgcggcggctcacggtttccaaaagcgcatccggttttgatgaatcgtcccgccgtatgcctaaaaatcgttcggcgcggcttcttttgccggcaatgacaaggcactgggtgttgtcttgagaaatgatgcgctcaaacagctcaatgccttcatctgtttctaacaggcgctgtccgcttgattgcaggtacatgcccgtcgtctcttcaccgccgacggccattccgccgtttttccagaccggccagtttatgacaaaagcgtttccgctttcggattgttcgtttttatagcgggcatacgccatttggaacctgttcgcgaccgcgtaatcacagcatccaaaatctcctaaaacagcagatgtggatgaaaagtagcagatgaaatcaggcgtttcgtttttcagccactcgtcaagaagcaggctcccgtttattttcggttcaagcgtactgcggaaattcctgatttcattttcaaagacggatgttctgctttcgatgcccgccgcatgaatgacgccgtgaatagctccgaatcgttctttcgcgcgcttgatgcagtcgcccattccgatcggatcacaaacatcggcttcggcgtaaagaacacccgcgccgagattttccaggtctttcattttttctttcttttcttcattgatcggcgaccgccccgtgagaatgacatttgcctggtagttccgggcgagatggcgggcaaataagtagccgagccctcctaatccgcctgtaatgagatatgttccgccggttctgatcctgccgttttctttcgttagtccggttggttcggtgtgatagacatatcgttttccctcttccaagaaaacggtatggtctgtttcagctttcagctcgtcccaaatggttctcatccagtccgttatggccgcgccggcttttcggaagtggccggtaacacttgttttcggaagaacaatgccgagcgaacgctcaaagccgatccatgattccaagtagcacctttccagaccggatgcatattcccccgccaataacagcctttccggctgcagaccggtctcagccattgctttgagaatatggacaatacatgaataatcttcgatgcagcttttatcttcaagcgcccataaatacaaaatggcagaagcttcaccgtactctttttgaatatccgcaaaagcgttcacatatgattgcggatcttcccgcaccacttggcagcggccggcggacaaggcctcataccggtctccctgagcgataaaaataacgtcaatgtcactgtcatacgatttgatcacagagacggcttcctgctgcttcttctgatcagttaagaaagaaatcaccgttttgacttgcttttctccggcagccggcagagcctgttctttaagaacttctctaaaagccattacttcaaactgctccgccggatcactttcatcagccggcgccttaacgggcgcggccttgctttgtacaggctgctgatgccagaagcgttctttcgcaaacggataagcaggcaggctgatgcgggccggaggacggtctccgtataatttcgcccaattgatgtccaatccttttacccaaagctcaagcagcttagaatatttccgtttgctgatccaagcgtctatgatggtttccatgtcatcatcggccgcaaatacggcaagcatccgtttgttttcttccgtgccgtcacggtgcagtccggcgctgttttgtccggcgataaatccgttcagtttttcctcaagttcatgaagtgaatggacgataaaaccgagacgctcttccatcggcacccggccagtctggagagtaaaggctatgctcataagatcgcggccgctgtatcttttttcacggatggcgtctctgagctgttttgctttttcagtgagccgttcgctgtttttcgcggacaggacgatgatggcgggctgatctgccggcgtctcatcaggctctttgtctgccgtatattcttctatgatgaggtgggcgtttgctcctcccgcgccgaagctgcttaaccccgcccttctcggaagctctttgccgccgatgacgggacgtttccactcaccgagctcctgctgaacggcaaacggcgtatacgcgaaatcaatatttgggttcagctgttccgcgtgcagggacggcgcaatttggcggtctttgagctggaataatatttttgtcagacccgcaatgcccgctgcgctttcgcaatggccgatatttgattttgctgagccgatggcgcaaaactgtttgtctgttgtatcctcatcaaatgctttcgttaatccggcgatttcaatcggatcccctaatgcggtccccgtgccgtgggcttcaatataactgacggtgcgcgccgggacgtttgccctttcgaaagcttcttttattaaggcggcctgcgcattcggattcggaacggtgtatccgttcgttttgcctccgctgttaatggcgcttcctttaatcacaccgtaaatgtgatcgttgtcggcaatcgcttgctccaacggctttaatacgaccgcgcccaccccttctccgtctacaaaaccgtccgcgcggtctccgaacgatttgcacgtgtcgcttgcggaaagcatgttcatgactgacagattcatataatgaatcgggtcggtcactatgtttacgcccccggcaatcgcgcattcgcttgaaccgctgtatatgctctcaagcgccagatgaatggctgtcaaagaagaggagcaggctgtatcaacggcaatgctcggcccttggaaatcaaaaaggtaagataccctgttggcaatggaccagtagccgtagcctgtcgggtagtttttgttcatcgcgccggcaaaaacaccaatttttctgctttggcacaggttgtcaggcgtatagccggcatcctcgatactcgcatacgccgtttctagaaataatcgctcctgcgggtccattcgctccgcttccaaaggagaaatctgaaagaacagcggatcaaacttgtccatatcctcaatgaagccgccccatttcgtataaatagagccttctttacctttctcttcatcgtagtaatcctgccagttccagcgttcctgcggaatttcttctatgcagttttttccttttttaatattggcccaaagctcagccgctgtttttgcctgcgggtagcgtcctgaaacaccgatgatggccacgtcgcgaaccgaactttgccggacggtctctctggctgcccgcttttccctccgccgccagtcagtgcgaagcggcttggccggctgtacagcctgcggttctggtgatgccttccgttcttcctgaacaggcgtttgtcccgtcagtttgatcatcgcgtcttttttcgttttgattaagtgagcgacgagcgcttcgatcgtctgatattcaaaaaataaagtgctgctgacttggtccaatacatttcgtaacgcgtttgtcagctgtacgacgacgatagaatcaattccgtatttttcaagcggcgctttcggatcaatttgagccggcggaatttttaacgtttctccgattaacgttttcaagtactcggtgcttttttctgttaaagacgtgtcgcctttttgcaccgttgtttgcggcgctttaaattccggcgcttgtgctgcttttggcggagcggtccgttttccggcccctgctttaagcgttttttggcggacaacgccgttgctttttgccgctataatctgatggcttaattcatgtgccgcttctgccgggaagaagacagaatgccagccttcactttctaacacgcgcttccagctttccggatacaagcccgggcaccccggaatacgaagggcagaatcttcatgcagccaccagccttcaagcagtccgaaagtaatatgcgggaacaggctgtttcccgccatttcatttaagagcagcaaaccgttgtcttttaagacggctttagcgtttctcagcgtctggcggatgtctttcgtcgcgtggagcacattggcggcaacgacgatgtcgtatgcgcccggctctatgtcctggccggcaagcggcgcttctgcgttaaaaagcttatacgtcagataaggattccgtttgccgtattccgtctccgcatgcacgagaaaagctttcgatacatcggtgtaacagtattcttttatatggttttgatacggcctaagcttttcaaatatgcctgcgcttgtgccgcctgtgcccgctccgatttccagtatgcggatctcggcttttgaatgtttgctgatgttttctttcacataagccgttaatgtttctgacagggcgctgttaaagtaatccgcgacttgattgtgcttataaattccttcaacaagttccattgaagagtgcgggaacatgatgtcagtcgccggcacgtcttcgcgcagaatgtccggcagtgctttaagcatcgtctcggctaaaacagtcatcgcttttgtatcggcgttattgagccattcctctttttcctgctcccatttttgccatagcgaggcggttgtgtcttcggcacgggccgacagtttatatgaatccgcattcccttccagataaccatgttccagaaggaaagcgatcgtttgattgagccattttttaaaatattcgtgttcgggctcatacgctttaaggctttgcggcgtcagcaagtctgcttctttaagctgggcgatcaaaagccgatacagaaaatcatcgagcttttgatgttcagcctcttttacaagacgtgcgccgggcggagcggccttcagctgttgtgaagagacaagcggctgagacggataaacggaaattttttctgtttcactcatcccttcgactgcgaccggttttgtcgtatgaatgaaagctgcttgatcaaccggcagcgtcataagggtttcaagcgcctccatcgcagcgtccggttcgatcaatcccaatccgatctgatccatcagctgaataaaatcgccgtcttcagccgcttcgctgttgccccaatagccccaattcatgactttgaccggacaattccacgtctgatcaagttctttcgcaaatgcgtcactgaaagcgcatcctgcggcatagtggctttgtttcacgttatggataaatgccacaagcgaggagaagaagagcgcaaagtcaagcggctcccgtccaaatacctccgccatggacacactgacatcggcttttgcccgcagcaccgatttgaactcttctgtcttcatattatttaagctttgctcagacagatccattgccgagtggatgattccgttcatttttgtgtgacgctcttttatgaactgataagcccgctctaaggaagcactgtcagcggcatcggcggaaacatattcaggcgccgggccgaatgcgctgagccggtcgagtttcgcctgtatggaatcattcagtgtgcttcttccgatccaaatgatatgtgctttgtagcggcggatcatgtattcactccatgcctcgccaagatatccggcgcctccgatcacggcataaaccccgcctgtttggtacagcgtgccgtttttcggcatattgtcaagcggtatcagctgccgctcaaacagctgctgattgcggtacgcccaaatttgaccgttttttccggcagaaagactgagcgcctctttgaccggccagctgccgtccgtttccgtgtcaatcatgcggatattccaatgcggatattctttcgccattgttccggcaagtccgctgactgcggcctgtgacggggcggcgctgtcttgatcggaaaacggctgggcatttgctgtgacgatgcaccagtccaaatgtttttctccgtaccccaaggcaagtaatgctttcatcagcttgaacacatgaagaacgtttctttcctgttccttgaggctgcaagcactctcagcctgcggagcaagccaaatgatttgctccagctctttttgtccttcaagcatgtacgtaagagatgtgatatcatccgtacctctgatcggataataggaagcgttcggcagatgttcttttatgcgcgtatgcgttctgtcagtttcaccgaaaaccgcagtctgcttttccgctgtttttgctttcttcgttttttcaagtgcaacgggctcccatgccggaatcagcatcgtatggccgacaggcgcttccggggtttctccgcccgctgtttggcctgtgtcaagcgcccggacggacgcgcctttcatccggacataaaccgtaccggcatcatcgcacatatcaatgtcaaattttcttacgttgtcatctgctttgctgccttctgtgtaccggatatatgaccagatatgttcaggacacggcccgaacacttccacttcctgcatcgcaaacggcagagaaagctcgtggctgtctgcatcgtcatgtattgagcggacaagcagaccgacggaggcgtgaaaagcggcgtccatcatactcgggtgaagcgtatactgttctttattgtcatgtacggcagccgggagtgaaatacgggccaataatcggtcttctccgatcagcaattgctgtacgcctctgtatgcctctccgtaatccagaccgatcttctcaaaagcaccgtaacattcttccgcagtcacggtccctgaattgcaggaagctttgacagactcgatatcaatctgggcgctttccggttcggtaatgaccgcttcaccctggctgtgaataaccggatcttcgccgttttctgcctcactgtatatttcataggtaatctcaccattatcttctgggtaaagggcaatatgtatttccttcggtttgtcttcaatcatgaccggccggacccaaacaacctgcctgagtgtgacgctatggtctttttccgtcacggcagcagcctttttaaccgcctctctggccatttccaaataggcaacgcccggcagtattttttgtccgttgacgacatggtcagataggaaaaattcatctccagtaaaaagagacgtgaagcgctgctgcgaaaaatctgacgtgttttcttgtaaaagcggatgcagcactgtgcctgacgggcttttctcctgttttttctgctgcggaatccaatagcgttcttttgcaaacggatacgtcggaacgcttgttttacgcggtttacccgaagcgtacagcctattccaatctattattttcccttctgcccataactcggcaagccgtatcggatcatccgtctcgggagcggtttcgctcagttccggcagctcggcttgtccgcgccaaagaccggggatgttttcgtttccttttacgaaatcattcagcttttctttcaagtcgcggatgtcatttacaaggaagacagctctctcttccattgcttcacgtcctgtctgaagtgtataagccagttcagacagcaccgtcttttctgaaagcgatcgggctagtttttccgcataggccagaagcctgtctttatttcttgctgacagcgggatgagttttgctgcattgttctcaggtgcaggcgctttttgttcaggctgaatgtattcttctaaaatgatatgggcgttcgaacctgatgcaccgaaggaactgagtccggcccggcgcggataatgtgtgacttttccgttttcttcggctgccggctgcttccacggagcagtctgctgctgtacgtaaaaaggagatccctcaaatttcaggtaaggatttaattccgcagaatgcagtgatttgacaagcgttttgtgatgaagctgcagcgccgcttttgttaacccgctgatccccgccgctgattctgcgtgaccgatatttgatttgaccgaaccgatggaacaaaattgctgatcctgcgtcccttggctgaacgcttttgacagaccttcaatttcaatcgggtctcctaacgaagtacccgtgccatgggcttccacataactgacggtccgcgggctgatacctgcttttttcagacaggccttaatgacttctgcctgtgcagcaggactcgggacggtaattccgcttactttcccgacgtggttaacggcgcttcctttaatgaccgcgtaaatgcggtcgccgtcttgttcggctttttccagcggcttgagcaagaccgcaccgactccttctccggaaacgtagccgtccccgccctcgccgaatgtgcggcagcggccgtcacttgagtgcatccctacgcttccgtagctgagatatttcgccgggtgcagcgacaagttcacccctcccgcaagcgcggcttcacattcgccgcggcggatgctttcaatggccagatgaacggcggtcaatgatgaggaacaaacggtatccaccgcgatgctcggcccgtggaagtcacaataataggacactctgttggcgatctgcgcataattcagtgaaaccggaaaaggatcagcttcagataattgttctgcgccgattaaggaataatctttatgcatcacccctgcaaatacgccgatcggatgctgtttctcccctttattccccagcgtttcaggcgtataccccgcatcttcaatcgtttcccagcatgtttctaaaaacaggcgctcctgcggatccatcgtttccgcctcacgcggtgagattctgaaaaactgcggatcgaaacagtcggcatcgtcaatgaaaccgccccattttgatactgtttttccagacggggacgttacgttttgatatgttttccaatcccatcgggacttcggaacttcagtgatgcaatcggtgcctgccttaaggttttcccaaaactccgccacacttttcgctttcggatagcggccggccattccgataatcgcgatgtctccggtgtttttatgatgttctggcgcgtccggcgcttcagcttcagatcgtgatgattcggctgcacgttcctccgcatattcaaatgaaccagtctttttcagaaaggctgcgagttcttttatatttgtatattcaaagagaagagtgggcgcgaggtcagcacccgtctttttactgatatcctgtacaatctcaagcaaagaagatgaattcagtccaagctcgtagtagcctgcaagaacgtccagcgtctcccaaggttgcccaagcttatcagccaaaagcttctttaaaaacagaatgatgtctttttcatctgcgctttccggctcagctgcagcctgttgattctgttcggctgtattcgcgtcttcgagccgaaccgcttttcccgtaatgtttttaagctccgccaccttttgtccggatcggctgaagtactcgatcgtcatcgttgtgagttctttttcctgacggacgccggaagcggcgatacgcgccgtgcactctgattgaagcctgtcagcggccgtgaacgattcataatataaaggcaggtgaagccggtttgtttctgaaagcaaaccgctccccccgattccgctcgcatccaaaagggccggatggaataaaaagaaatcttttccttcttcgcaagaaagctcagccagcatgccgctttctgtttcgtacaattgtccatttgatttcatcatgccggaatgaaccaagtcatgatccagacagcggttatacatatcatcaagattcagagacctggctgactgcttcacatcgctgaaatcaatgatttcgtcaaatgtgacagcgtctcttttcaccatttcagccgtcgcatattgtatattgtctgacagctcgtcaccttgctgtttctgccctgaaagggagatgagccactttccatctccgctatcagaacattgaatggtcagaatgattgcagccgtttcactgacggttaaaggctgataaatcgtaacgtgcttcaattcaagctcattgtatacataaccgtgttcctgaaaaacctgataaatcaaatcgatataagcaagaccgggcaataccgcttcaccaaagaccatatggcccttcatgatgggatgatccagtgagatattgattttttccgatatcattccttcccactcctctcttatttaaatgctttccaaaacatttttttcgcaggaagctcttgtttctccgctcgtacgtcaggttcttttaccagagccttacgtcttaatgacggtaccggcagcggctttcttttcattcgggtatctttttcttcccaagcttccagaatgacgtgggcgttcgttccgccgtcggcaaagcagttgatggctgctgacggtctggctgcatcccattcgccggctgttttatgaaagtgaaaatctgtctttgttatatcaaaatgcggcatcggttcgtctcctgagagaaacggaaccgtttgtttatgcttcagcattaatacgactttaatgaagcttgcaatgccttctgcgcaaagcggatgcccgatgttcggcttgattgacccgatgccgagcggaacatgctgacctgagcggtatacggattgaatcgccttcagctcaagcaaatcagtcaccgcggaacccgatccgtttgcttcgatataagtgatgtcttccggctttttgccgcttttgagaagcgcgctttgcataacgtctttttgcgcctgcatattcggggctgacgggcctgccgttctgccgtcattgttcatggcggcagccttaatgaccgcgtgtatcgtatcgccgtctttttgcgcctggcttactgtttttaacagcaccatgccgacgccttcaccgaggaccactccgcctgaacgcttgtcaaatacgtgaaatgccggtttctcgtttaacagcccgcgctcttggaacatccggtgcgccgcatccgtgttcagcaggctgacgccgccaactaccgccgctttgatatcgccgcttctcagtgcctgaacggccatgttcattcctgtcaaagctgatgaacaagccgtatcaagcacgatactcggcccgcgcagatcaaaaaattgcgaaacgtttgccgctaaataattctgcccgcccgcaacaatcgggttgcgggtattcgcaagactttcaggatcaggctgatgctggctgcggcctccgatatacacaccggcttctatgcccttgatttcttcacgggtatagccggcatggcaccaaagtttcaagctctcttccagcaccgccaacgcctgagggtccatcgctttcgcgtcgttttccggaatgaaaaagaattcggaatcaaagtgatccatattgtcaatcaatcccgcaacatattgatttgcatatccgaaacgttccgccgggacggagccgattgcggacctgccgcttctcagcaagtcccaatattgttctaacgattccgctcccggaaaacggcagctcattccgacgacggcaatgtcttcagttacagcagcacgcttttgctcagtgtgaaccgtttgtacggcagccggaaccaacatttccgtatcaggttcctccctttctgcaagcagcggctgcccattggatacaagccattcggcaaacgcgtcaatcgtcggatgttcatataaaacagacggatctaagtcctctttgagcgcttgattcatttgctgtaaaagctgcgctaaaatgatcgaatcaaccccgtaatcctgaaacggttcgtctgtttccagatcttccggagcgattttcagctcatcggaaaacagtttcacaagccatgccttcgtatcaagaagcagttctctgtctgaatgtttttccgcgtctttgccgtttattacggcttcagtctctttttgttttttctcttgacagagcagcctgtcgggatgccattcgctccgatcaacgatagccggcagaacggacgggcggatgttttcagataaaatgcggtccagcaagtcaagtccttccgcgttggacagtcccagcagcccggtctgcttcaggttttctgtgcggatttcacccaatccggtttccttccagttcggccattgaatgctgactaacggatattgatgctgatgagccgccgcgaaataatccatgtacgcatttgccatcgcataatccgactgtcccgccgcgagtgccggaacgactgcagatactgaagaaaataagacaaaaaattgcaaaggatcatttgtgaaaaggctgcttaatgtttgaagcccggcgactttcggttcaagcacttcttgtatgtcgtcggcagtctttctgataaacgccggatttactgaattaaccgatcccgcacagtgaatgacgccgccgatcggtcccatcgtgcgccggatcgtttcaatttccgctgccgccgcgtcatgatcagacaatttcagactgatcaccgccacttgcactccttttgcttcaagctcttcaatcgcccgtatcttctctctcagcctcatattaacggctgtccgtttatgacggggaggaatcggctccctgcctgtcagcactacttttttcacgccgtgtttttctgtgaaatggcgggcgcataagagacccagtcccctcgtccctccggtaatgaaaagcacatggtcttcaggaaacggtgctggcttatgttctgctcgcttcccgcttggaatctcgctgaacaaagcacggtatctttgtccgtttcggcggcagacttccggttctgtgctgtccgccgaaaattcatctgcaatctgtttggcaagcgtctgctgatccgtatctgtatcggtatccatgtgtctggacgtcacgttttgatactcattttgaagcattctgtacaggccgctttttgccgctcctgcaagatgaatcgttttctgctgaaatggctccaagccttttgttacatatagcagcgtcagcggccgcgcttgccggcggcttgtatcaatcagagtctggagccggctgatcccttccagtgaagggtcttcgtctccgcatcccgtcagatcgattacgccatctatgtgattccaatcgctagctgcagtgtcagcggccgggagaatgaacgagtcagcgaaatgcttcgcagtctcttcggcaagttccgctgttcttgcatcagccagaatcatgaccgtcctgccgcttttctcaccggccgaatcgatctcacacggaacccattgcttttctaaaagcacagccttgcgccggtcttctgtttcctgcggtacggctttcggctcaggcagccagtacggctccttcgcaaatgggtaagccggcagactgattctgcggggtttttcgccttgatagagtctgtcccagtccgtctgaagccctttggcccacaattccgctattttggcgtattttttcttatcgaaccacgacctgacaagctgcttcagatcatcgtccgtttcaaatgctttgatttctttttttgccgttttgatgtgggcttcatatatcccttcacccgtatttccgtttacaaaatcggttaaacggctgatcagttcttctctcgaaccggctgtaaccgcaagacggtaatccatcgcatcacgcccggtctgaagcgtgtatgccatatccgaaagattgatattctgattggcttttgcaaattcgatcacagactcagcataggtttttacctgcggcgcttttttcgccgacagcacaaaaatgtttgtctcatcagacttgcggcttccccggtctttcggctgatactcttcgataacgagatgagcgtttgtgccgctgtagccgaatgagctgacgcaggcccgccgcggtgctccgcctgtttcccaaggtttaagttcggtattgacaaataaaggcgagtcatcgaaatcaaaatgttcattcggcgtgctgaaatgaagggtcggcacaagctgctggtgcttcatcgacagcagaaccttctgtacgcttgctacacctgccgccgccgacgtatgcccgatattcgatttaaccgaaccgatggcgcaaaattgtttgcggtccgttttttccttgaatacagaagataaggcttctaattcaatcggatccccctgctttgtgccggtgccgtgcatttccgcataggtgatgctctcagggtggatgttgtgcgcttcatacacttgacgctctaaatccatttggcttttcgcgcttggtgcggtaatgccgttggtttttccgtcttggttaattccagatccgataatgactccgtaaatatggtcttgatcggcttccgcatctttcagcctcttcaaaacgagcgcccccgcgccttcgccaggcacaaatccgttcgcactgttatcaaatgctttacattggccgtcaggagacagcattccggcttcacacatgctgatgtatgattcaggcgttaaatacaaggtgacgccgccgacaagggccatgtcaatttcatgattcaacagcgcctgacgcgccaaatgagtcccgacgagagatgaagagcatgccgtatcgatcggaatggccggccctttcaaattgagataataaggcaggcgggccgccgcgatgctgaaactgttgcccgtcgcgcttcctcctgtctgatgtttgtttaacatcattccgtattcattgttcataatccccaaataaacgccgcaattttttccgtttaattcttttgagctgtaacccgcatcttcaaaggctttaaaaccttcctgtaaaaatatccggtgctgcgggtccataagttccgcttcagacggagaaatattaaagaacagcggatcaaactcttcaatgccgtcaagcataccgattgatctgcagtatactttgcccttcttgtttaaggccggatcatagtatttgtttacatcccagcgggaaagcgggatgtcgcggatagcgtttttcgcacgggctaagttgtcccaatatgcctttaggtccggcgcatccgggtacttgcccgacatgccaactatggctatcgcgtccgctatctcgtctttaggctcccgtttggcctgcaccggttcaggttccttttgaaccgttaatctctccggctcggcaggtgttttctcctgcggggcggcttgctgtgtaagcggctttggacgtacgggaaccgcctgtttttttctgccgcggacggacggctgcgtacgcagaaaatcggcaaattgacggattgtcggataatcatacactttcgttacgttacagtccgtgccgtaccgtttattgacggcctttatccattcaagaccggtaatcgaatccataccgaggtcaataaaggcctcatcaatatccacttcatgccgctccatgtacaatacatcagccagtgcttttgataactcgtcatgcaccgcttcaatcggttcttccggttcggcggaagctgccgtttcagacatcgcctccagaatatccgcttctgcttgtatcacatgctgcttatgagcgtttaaaggctgcagcagtatgtttgacggtttttttacggcctctgttttctgcggttcggctgcttcctcaaggatcggttctgtcccgagttctttttgcaagaaggccgcaaactggcggattgtcggataatcatatactttcgtcaccgtaagggacgtgccgtacgctttattaacggcctttatccattcaagacctgtgattgaatccatgccgatatcaataaatgtgtcatctgcgtcgatatcgtcggcatccatatataacacgtccgccaacctttccgttaattcggcacttactttttcagcggataccgccggacgggaagcagactgtacggttcttttcggtttcgcgccgctcaaaggctgcaatgaaatgtttgacggtttttctttggcagtctcctcgtgaagagttgctacttcaatgaccggttccgggacggccgccggtgcgatcggcgcagactgtgtttcggccggtcttttgacagctgcatcagctgatgtgtcgatccaataacggtcttttgcaaacgggtaggccgggagactgattttttgcggtctgcccatttgatacagcttatcccaattcagcggaaggcccttcacccaaagctctaatacctttgcggctttgcctttttcaagccatgcctcaatggttttttccatgtcctcatcagccgcaaacagcgccatcgtgtctttattctgtttgacttgtccgcggtagagccggtcaattgactccttgccgcccgtaaattcgtcaagcttttcttcaagctcgcgcaaattgctgacaatcattccgagacgctcttccatcggttcacgtccgatttgaagcgtatatgcgatccggctcagatccgcttcttggtaacgcccgctccgcagcgcatcaagaagacgttccgcccgtttttgaagcctttgttcatttttcgcggaaaggacgatcatcgatggatgaggagcggcaaaagccgtctccttatcctcatcagcggtatattcttcgatgacgatatgagcgttgacgcccccggctccgaatgaggaaagccccgcggttctcggcagttctttatttattccgttttcatttatgaccggtcttttccactcttcaagcgtctgctgcactataaacggcgtagcgagaaaatcaatattcgggttaagcgtccgggaatgcagtgacggtgcgagcttcttatgtttcatttgcaggagcaccttcgtcagacccgcgatgcccgccgcgctttcacagtgcccgatattggattttgctgagccgatggcacaaaactgtttatcttgtgtttgttctgaaaaggcttttgtcagacccgtgatttcaatcggatcaccgagtgaagtcccggtgccgtgggcttcgatgtagctgactgccctcggatcggttcccgcgtcttttaacgcctgtttgatcaccgcggcttgggcgttcggattcggtacggaatacccgtttgtttttccatcatggtttacggccgttcctttgatcaggccgtaaatatgatcaccgtccgctttcgctttagaaagcggcttaaggagtaccgctcccactccttcaccgggcacataaccgtccccgccttcaccgaaactttcacatctgcctttgcttgataaaaatctgttctggccgagcatcaaatatttattcggatgaacggatacattgacgcccccggcaaatgctgtctcgcattccccgttccgcaagctttggcatgccagatgaatggctgttaaagaagaagagcacatcgtatccagcgccatgctcggaccgttaaaaccgaatacataggaagccctgttcgcaattgatgacggatttccggtcagcgcaagcgattttccgcgcgcctgttcttcggctccgtaaagctgatattcctcatacatgacgcctacgtaaacaccgacattggcgccaagcaaatcacccgatttttccgtgagctttttgcgcgtgtaaccggcatcttccatcgtttcgtagacacattgcaggaataaccgctcctgcgggtccatcaattttgcatcccgaggcgaaatagagaagaattgcggatcaaatttgtccacgtctttcaaaaatcctccccattttccgtacgtcttgccttctttatctttatcagcgtcgtaataaagactgtgatcccagcgatcgtttggaatttcagttatgcagtcagtgccttcactcaagttcttccaaaattcctgaagattttcggcttgcggatatcgtcctgatataccgataatcgcgatatcttcacgctccgtcactggatttttccgcgtgtctgtgcggacttgcgcaaagccttttttggcttcattccgtttggaaacgggctttatttcggctttttcagacagcgccggtttggctgcagaggtttcttctgttttcagcccggtcacttccagcagcgtgtcccggtgtgctttcataaaatactgcgccagcgattcgatattctgatattcgaaaaacaatgtttttgacaatgaaccgaagctcttttccagccggcccgtcaaatgcataatcataatcgaatcaattccgtaatcttccataggcgccttggcgtcaattttgccgacaggaagttttgttacttccgaaagcacatgtttcaagaaatgctccgttttttctgcaagcatgttctctccgcctgccgtaagacctgccggttcttccgtttcgctgcccttatccggctgatcatccgctgattttttcagaaacgcccggatttttgcggcgtagccttccgtcaccatgatttgggatgtgtttgccgcccacccgcggtacaaagcatggatgccgttttctgttttcatagggaccatgccgctttcttttgtcagcatcgcttccgtttcagcatcaaccgtcatgccgccgtctttccaaagcggccagcagattgaaagggtgtgtccatagcgttcatttcgggcttttttacggtttcttttttcactgaaggcgttcatgaacgcattggccatcgcataatcagcctggcccgcgcttccggcgcttccggctccggaagagaaaagaatcagaaaatcaagctcaatgtcctttgccgcttcatcaagatgaaccagtccggagactttcggcgccagcacatcacggatttcacctttgtgctttttcagaatataattgtcttttatcgttcccgcgctgtgtatgataccgtttaatccgccgtactgtcggcagatgtccgctgtgagcgattgaacttcttgtttttccgtcatgtccgtttgtttgtacacggcttgcgcgccgagatcggacagttcttgcagctggtcttttttacggttatccaacagagaacgccccgttaaaataagcacggcgtcttttgcatgtcgggcgatttctttggcgaataaaaatccgagtccgcccgcaccgcctgtgatcagataaacacctttatccttccacggcttttcggcgccgaactgttcaagccctgtttcctgccattgtgccgtatagcgcttgccgttttcatagcgaatatgtttgtcatcaggatgagcgctgcattcttttacatatcgggacagcgtgtctgccttgacgtccggctccaattcaatcagctggccggtcaggttcgggttttcaagcgccgctgttttcaaaagccccgttaagccgcaaaggagctgcgtatccgcttcttgaggcacgacaatctgaatgagctcgcgcccgccggaatttgaagcgagaattttcttcacttcttcgaacgcctgaagcgcacaagcttcaaaccgttcgtcttcactcttatgctgatcacggagcacgtgacagctgaagtctgtctgtatgctgttcatttgatccgtaaaccggtctgatatcatcacgtgacgggctttgaaatgagtcggcgctttttcatgtacagcggccttctcttcccatacgtgttcaaaaaatagtgtatctgttttatccgtttcaatttcccgtgcggaataaccagtcattttcacacatacattgccttgttcgtcacatacatcaatatccagcttctgcacggcatcttctggcttgctttcgccgctgtacgcaatggaaacccacatatcgcttttacagcttttcaacacatcaatctgttcgagagcaaacggcagcatcggccttatgtcatttccgtctctgtcaagcattaacccgattgtcgcgtggaaagccgcatccaaaaggctcggatggaggacaaactgatcttttgtatgagaaatagatgacgggagtgagagcttcgcgagcactttgctgtcttttgcatagatttccgtgaccgctttgtgagcatccccgtattcaatccccatctgtttgtatgcctgatagcaagcgtcaggtgtgatcagacggcgtgactctcttaatttgtcaatctcgattttggccggttcgccccctcggacaaacgccgcgcttccttgcgcatagagaacgggctcttgttccgaggaagccgattcaccgtaaaccgtgaagcccatctccccattttcttcatcataaagacggagatacagttctgcggattcatccgccgctgtaaacggacgtatccatacgacgtttttcagacggactgttccttcttccttcgtttctgccgcgtgttcaacggccgcccggaccatttccagataagccgcgcccggtaacgtccgctcgtttttgacgacgtgatctttcaggaaaaattctccgccgctaaaagaggaccggaaacgaacacctgacatgtttgatacattttcatgaaggagcggatgcagcatgcctgcccttttttgcggcagcgattctcttttctccgccttcggcacccaataccggattttttcaaacggatatgtcggcaggctgatccgattcggtttgttttcaccgtacaagagattccaatccatcgttcctccgccggtccacttttcggcaatcatctccagactcccggaagaaagccatttatgtatcaagtccggagcaagctctgcctgattgcttttatcggctcggttccgccagcatccgctgaccgttttacccgccagaaagccttccagccgctctttgagctgtgtcatattctgagcggtgaacgcaacccgctcctccatctgttcacggccgatctgaagtgtatacgccgcatcctcaagcggcaggccgggataaataaatgaagacagcttcgcaacatactcttttagccgttcttcattccgggcggaaaccgggaaaatgaaagtctgttcttctgccggttcatacgctgttctccgtgattcttcagggataaattcctccagaatgagatgcacgtttgaacctgtcgccccgaaagaactgatgcccgcacgccggggatatacggtctcgtttccgttttccgtcactgatggctgctgccatgcttcggtatgatgctggacgtaaaacggtgattgttcaaaatctaaatacggattcagctcctcggaatgaagagacggcaccaaagttttatggtgaagctgcagggcaaccttgcttaagccgctgatgcccgccgccgattccgcatggccgatattggacttcactgatccgatcgaacagaactgtttgtcctgtgtgtactggcggaacgccttgacaaggccttgaacctcaatcggatcgccgagagaagttcccgtcccgtgcgcctcaatataactgaccgtgcgcggatcgatgcccgctttgtccaggcattcttcaatcaaatcggcctgcgcgacaggactcggcacggaaattccgctcactgtccccacgtggttgacggcactgccctttatcaccgcataaatccggtctccgtcttttaccgcctctcgcagcggttttaataaaacggcaccgattccttcagccggtacatagccgtctccgtctttcccgaatgtatgacaaaccccgtctgttgaaaacatgtcccataaaccgtatgtcagatatttattcggatgcagcgacaagttgacccctccggcaaccgccgattcacattccccgcgccgaatgctttccgcagcaaggtgaaccgcagtcagcgaggatgaacagaccgtatcgacagccatgctcggcccgtgaaaattgcaaaaatatgaaactctgtttgcgatttgcgcataattaagagaaagcgggaatacatgatcttcagaagaagcttcagccccgaccaacgtataatccttatgcatcacccctgcgaagacaccgacgcgctgcctcttattccgtccgcgcgcctctgcgagcgacttcggcgtatatccggcatcctcaatcgtttcccagcatgtttgtaaaaacagccgttcctgagggtccattgtttcagcttcccgcggcgtaatccggaaaaattggggatcaaagcaatccggatcatcaataaatccgccccattttgaaatgctctttccggaaggcgactttacattttcaaaccggcgccagtcccagcgagactccggaatttcggtgacacagttttttccttctttcaggttttcccagaattcatgaatattttcggcctgcggatagcggccggccatgccgataatcgcgatatcttcatcttgcggaacactgcttttccgtcttctttctgtttgcttctcaacctgcttctctatttttgcaggagacgcgctgaaatggcttccgtactgctctgtcaggaaagccgccagctctgatgccgtcgtatattcaaacagcaaagtcggagaaagggtttcgccgattttttcactgatcgtttcgacgacgtcaagcagtccggacgatgtcagccccatttcatagtagccgacttgagaatcaatctgttcaagcggcttgccgattttttcagccatcagattcatgacataccgttctgcttcctcatgcgggtgtccgccttcaagcgatgccgcaacttccggtaaaccgactttttcaggaggcttctcagcagtctttcggtctgtattgatcagctcggcatcccgcacgagcttgcttgtgaaatctttcagctcggctacttttcggccggatgtgttaaaaaactccagtgtaatgtaaatgagctctttttcctgccgaagcgacgaacgtttgattctcgtgatgcagccggcctgcaaaggttcggaagctgtaaaagattcgtagaaaagaggcagaaacagcctcttttccccatttaacagcgaggagatcaataggtttgcgccgacgccgcttccgtcaagaagagtcggatggaacaaaaacccttcggcctgtcccatcgcgtcttttccgagcgatacatcaaaggtgacgccgtcccgctcctcaaacacttctccttccgctttcatatatccgctgtgaaccaattcctggcttctgcattgggcatacagctcatttaaatcgatggtgcgttccgcctcgcgtttgacagagtcaagatcaagcgtgtcactgaaaactgcgggtgccgtctcgtgcatttccgctttgacgtaaatacgttcttccggctggactcgtccgccgctgacctcagccccttttgcggtaagtttccagcgcccttcttttacctttgtacattcaaccgtaagcttgacggcgctgtcttctttcgcgataagcggctgatatatggataaatggcgcagctgaagcccgtcgtatgaatagccgcgctctttaaaaatctgataaaacatatcaatataagccaatcccggaaggactttttgtccgtaaacgtcatgatgtaaaataaacggatttttcagcgataaagtgatttgcttattgaagttcttcacgttaaacctccacttcataggtatcccagatgtttgccgcagctttttcgttcgtttcttctttgctgtccggcgaaatcagccgcttatttaatgcaggcggtgttaaagggtggcgcttgattcggcgcccttcgtctccctgccacgcttccacaatgacgtgggcatttgttccaccgtcggcaaagcagttaattcctgccgccggcattggtgacggccagtctgccagagtgcggctgaactgaatattggccttttctctatcaaaatgtgtgttttcatgctcacctgataaaaacgggataaagctcttttctttcagcatgagaacaacctttatgaaacttgcaattccttccgcgcaaagcgggtgcccgatgttcggtttcacagatccgattccgagcgggccggcgtcttttgaacggtagacggattgaatggccttcagttctaacagatccgtcacgaccgtgcctgaaccgttcgcttcaatatgagtaatgtcttccggctgttttccgcttttttcaagagccgtcttcatgacggatttttgcgcttccagactcggcgtagccgggcctgccgttcttccgtcattattgacggatgccgccttcactacggcataaatagaatctccgtctgcaatggcctgagacacggtttttaaaagaaccattccgacaccctcgcccagcacgactccatcggcgcgttcgtcaaatacatggaacgactgcgctttacttaatatgccgcgctgttcaaataatttatgggtttcttctgattcaaacaggctcacaccgccgacgacggccgcttttatttctcctgttacaagagcctgcacggccatattcattccgactaaagcagaagaacaagccgtatcgaggacaacactcgggccgcgcatatcaaaatattgagagagattggcggccaaataattctggcccagcgcgacgatcgggtttttcgcatccagcagtttctcttcacccggtctgtgacggctgcgtcccccgaggtacacacctattgcttctccctttatctcatccggcgtatagcccgcgtgataccacaggttaagacattcttccagagcggccaaagcttgagggtccattgcctttacatcttcttcagccagtaaaaagaagtccggatcaaattgatgaattccatcaagcattcccgcgtaataaggcgtcttcacccccatcgctcagccggaacaggaccgatagccgaacggccttcagccaaaagcgaccagtacgcctctaaggaagccgcccccggaaaccggcaggacatgccgacgaccgcgatatcttcccggtgaatctgtttttcggccgcctcttcttgcaccttaacggcttgtgttacaattaccggctcagccggcttcttcataacaggctcagccgccgccaaatcaaaccgttctgacaaaacttctgtatacccttcgagaagccattttgcgaaagattgaatcgtcggatattcatacagaatggacgggtcaagcgatgccgagagattccgattgatccgctgcagaagctgagcaaggataatggagtccactccgtaatcttggaataatacgtctgtctcaagctgatcctggtcaatccgcagctcttcagaaaataattctttcagccattcttctgttttccttgttaattgagcgttgtctgcggcggtatcagcggttttttccgccgattttaccatagccgggctcattggctgatcctgcctgctccgccgcaggaatcgctccggcttccacagcttaggattcagaacggccggcagcaccgggccccttgctgattcaagaagtatgccgtcaaggagctgtaatccttctgcattcgtgatgctgtatagcccgctctctttataagctttgttcgttacttcgcccattccggtttctttccagttcggccactgaatgcttacgatcggcagctgctctttgtatgagtctgcaaaatagtccatatacgcattggccatggcatagtcggcctgtcctgccgaaagcgccggtatcgcagctgacacagaagagaacaagacgaaaaacttcagcggctcttcgctgagcacactgtataacgcctgaagcccctctactttcggctcgagcacgcgctgtatgtcttcatcggtttttctgatgaatgcgagcgtctctttatcggtcacacccgcgcagtgaatcacgccgccgataggtccgagcgtctgtttgatctgactcaattcctgtctcagcccggcttcatcagctaacgggactgacaataccttcacttgtacacctttggactccaagtcgagaacagcttcaattttcgcttttacagaagccgtcaccccattcagtccgcccgtccactcacttcgcggcggaagggtctcacggcctgtaagcaccagttttttcactccgtaatgttcggcaaaatggcgtgcgcataaaagaccgatccctctcgtccctccggtgatcagaagcacatggtggtccggaaaatcaattctctcgccttgcgtattcatattttctgaaccgctcaatacggcgcggtagcgcaagccgtccctccggcaaacttccgcgtcatcagtacgggcatgaaactcatcggcaatctgcttcgccagtttgtcatccgaaagcgctccttcaagatcgagatgccttgaagacagatgactgtactcgcatgccagcattctgtacagcccggcccgttttgctcccgttatttgattggcctttttccccattgactcaaggtctttcgtgacacaaagcagtgttatcccttctttatgcccatgctcaatcaattgctgaagccatttgataccggtcatatctccagaagcttcttctttcgctgcaccgagaaggtcgatgactccgccaaacgcctgccagtcatattcacctgtaaggtctgatgttgtgataatacggtgattcggcatatgcgctgcgatctcttctgcgagattgatcgtgtccccgcctgtcaaaatcgcaacggaacgtgggcacggttcacgcagttcgagcgggctcggttcccattgttttgtcagaatacgtttcatccgttcctctgtatggaccttatttttgtcaggattctcaggcacccaatacgtgtcttttgcgaacggataagacggaagactgagtaaacgcggcgtacccttttcatacagccggttccaattcaacacgccgcctttcacccatacctctgccagcttggcgaattttccttttttaatccaggcgtcaatgacgatgtccatatcttcatctgccgtgaacaaggcaaacgtatctttattgcggtgagactggccggtatacagcccggcgatgtttttctcatttttcgtaaatgcttccagctttgtttccaattccgccatcgtcgctgcaagaatggccaggcgctcttccatttcgtcccttccggtttgcagcgtataagcgacgcccgccaagtcttgatctgtatacggcgtttgacggatcgctttttgcagctgctgcgcctgttcgaacagtttttcttttgatttggcggacaaaaggatgattgccggattttccgggctgtgctcaggcagagcggctgctttcgggacatactcttcaatgacgatatgggcgttgaccccgccgatgccaaatgagctgaccccggcccggcgcggaatggcatttccgtttctatctttcgctgccgtccattcctgattttcccgcacgatgtagaaaggactgtcatcgagctgaatgtacggattgatcgtctcgcaatgcaggcttttcaccagcgttttgtgcttcatttgcaaaagcactttcatgacgcctgatactcccgcggcaagctctaaatggccgatattgctcttgaccgaaccgatgccgcagcggtgatcggagacttcaggctcttgatttgttttcgccagctcgtgaaacgccgctttcaaaccgtttatttcaatcgggtcgcccaattccgttcctgtaccgtgcgcttcaatatacgtgacggtgctcgggtccactcccgctttccgatatgctttcaccaataaatcagcctgcagtttcggattcggcgaggttaacgtattcgcccggccgccgtggttttcagccgtaccgcggatcacgccgtaaatcggattgccgtcacgttctgcatctgtcagtttcttcagcatcagaattcccgcgccttctcccctgacatacccgttggcatctttggagaaggttttgcattttccgtctttgctgagcatgcctgctttgctgtagctgatatgcgcttcttccgtcagaatcgtgttgattcccccggcgatcgccatgtcgcattctccgttttctatagcggataccgcccggtgaatcgcaacaagcgagcttgaacatgccgtttcaaccggctcgctcggcccgtgaagatttaacaaatagcttaaacggttcggaccgatggaaggaatcatgctgcctgtcgccgcatgtccttccggcgcaagacctgcccttgtgaacaaatctttataaccggtatttccggtgccgataaagacacccgtatttgtgccggaaaggctttccggcttacagcccgcatcttctatcgcccgccatgcataagtcaataacagccgctgctgcggatctaaatattgggcttcccgcggtgaaatcccaaagaacagcggatcaaattcagctattccgtcgataaagccgccccacttaatattcgttttgttcctttcaagattcgggtcgccatcaaacgcttgccaatcccagcgttctttcggaatggttgtgatagaatcttttccttctttcagattgcgccaaaattcctctatatccttcgcgcccgggaatcggccgctgattccgacaatggcaaccgggttcaagcggcgcggctcttgtgtcgctgccctagcgttcatcaccgttgcgaaacgctttttccgatgcgttttcggtttttgggcttttggctgctcttttttcggagactccttcttcttttcgccgaaacggcccggatgctcttttgccaaatatccggcgagattactgatcgttccgtactcaaagaaaatcgtcggcgccagctccagctgatacgcttcatttaattgattcgtaaagacggtaaaggatacggaatcaaaaccgtattcactcagttccgtatctgtatcaatgtcctcacggtcaacttttaaaatgctgcttaccatggctgtcaaagcggtgtgaagcgcttgaagagattcttctgcatcgtgtttttcttccggctgaaaaggaagacctctctctgtttcatccgacaaatactctgctaaactgcggatcgtcccgtgctcgaagaagatcgtcggtgccagctccagctgatacgcttcatttaattgattcgtaaagacggtaaaggatacggaatcaaaaccgtattcactcagttccgtatcaatatcaatctcgtcttggccgacttttaaaattgaactgaccaatctgataagcgcaccgtgccatttgtctcccgaaacggcggatacaggttctattttctccacctgcggcttttcagtttcagaaacggacaggaacgactgttttaattttgctgcgtgtccttcagctgctaaaagctgcggcttttcctgagccattccttcataaaatgcagccaggcctgacgccttttgaagcggaaccatgccgaaagcttttttcatcattctttccgtctcgtctcccgcctgcataccgccatctttccacagcgtccagttaaaggcgatcgtttttccgtgccgcaggccattctccgtaagggattgcctgtaagcggcgtatgcatccataaacgcgttgccggcggcataatcagcctgcccgacattgccgagaacgccggaaacactggagaacaatacgaaaaagtcaaggttgcagtctttgctggcttcatctaaataagcggtgccgatcactttcggatcaagcacttcccagaactcttccttcgttttttgcagcaggaaacggtcttgtatcacgcccgctgcgtgaataattccgttaagctccccgaattccgccgtaatctcttttatcagcgcttcattttcccgccggtctgccgcattcagctttttgtagacgacatttgcgcctgagtcctgaagcatagcaagctcacgctgtttggcttctgccagatttgagcggccggtcagaatgattttcgggtgttttacgcgaccagcgatttcttttgcgaacatcaaccccaggcttcctgcgcctccggtaatcagatatacgccttcgtccttccagacggcgccgccacctgcaggatgcatttcttcccaagccttcacataccgtttttctcctgtataacggatatgtttatcatgcggccgatggctgtcgtttttcagtttttgagcggcagccggcatttcgccgattgattccatctcgatgagctgacagtcaagttttccgtattccagctcggctgtttttaacaaacctgttaaccccgcaaacaattgctggctgccgtctgctgaaataacagtctgaatcagaatgcggccctgccttttttcgctgatgatccgccggatgtgttcggcgattgtctgcgcgtagccttggaagcgttcagcggctgtttctccctcaccttctgcaatcagcagctcggcgtctttcaggccggatgccgcttcatcttttatacggcaggcatcttcacaaagtatgatcaaatgctcatcagcatggacagaagctttctcggatgcggcggcttctttccaaaccggtgcaaacaagaccttttccgagcctgatggccgctgagccgattctgcatcgccttcaagcactctcgtagagaatcctctcaccttcacgcaaagcgctcctgtttcgtcgaacaggtcaatgtcggctttctgcacggaatcaccggtttgatatccttcgctgaagcgtgcatgcgcccgcatagtcggtgtgcatggtttgatgacttcaaggtattccagcgcaaacggcagaatcagcttttgtccggaaaactcctgcataatgcagatcgtcgccgtctgaatagccgaatcaatgatgctcggatgaagcgtaaattgtccgttcgtatgagaaacagaatccggaagctgtatatccgaaagcacttctttctcgccgataaaggcggacttaatgccttggaaggcttttccgtggaacatccccctgctccggccttcccgataaaaggccgccggatcaagaatgtccgctgtgcatctgttttgtatggcagaaaggtcggcctcaggctctcgttcagcctttatgatttcagcccgtccttggctgtgcagcacttcttcatcgtcagcgtttacgctgtaaatgtcatatgagatgatgccgtcctcttcaggaaacagcgcgatatggacttggcgctcttgttcgtgaacgacgatcggtttcatccagacggtatgatggagcgttattctgtcttggtcttttaataagccgccaagcgcccgttttaccgcttcataagacatttccaaatatgccgctcccggcagcaccgctttttccctgaccacatgatccttcaggaaaaattctgagcctgtaaaccgtgagctgaaccgctgaacggccaaatctgacgtattttgctgcacaagcgggtgtaaaactgagactccggtgtgtgcggcagatgttttcttttctgcttttttcggccagtacggctcctttgcaaacgggtagaccggcacgctgatccgtttcggatgcttgtctttgtaaagcttgtgccaattaatggcgacacctttactccacatttcacagagcttcgttccttttcctttcgcaagccatttctcaatgagttcagcgctgtcatcatcatcagaaagccaggcaatatcttttgcctgctgtttttctcctctaaagcagcctgttacagccggcttatcattgataaaatcggcaagctgccgcttgagctccgcagtgccgcttgtgataaaggccgcgcgctcttccatcgcttcccttccgacttggaacgtgtaggcaagatcagcgaggccggcgtccgtttttctttccagaaaagccagcagctgttttgcgtactccttcagacgatctttttttctggcagacaacggaatgatgaacggaccggcagcgtctgctgcttcggatgcatccggatattgttcaaaaatcgcgtgtgtgtttgttccgccaagaccgaaagagcttaaagccatgcggtgcgctctgttctcacgggttaactctttcttttctcccgctacgtaaaacggagagtcttctaaatgaagattcgggttcggctctttgtaattgatgctcggcgcgatttcctgatgatataagctcatgacaaccttgatgcagcccgccattccggccgctgtatccaaatgcccgagatttgttttgactgaaccgatgccgcagtattgttttttatctgtatatcggccgtacaccgattgaagtgcggacagttcgatcgggtcgccgagttttgttcctgtgccgtgagcttcgacgtacgcgatcgtttcaggatggatgccggtctgatcaatgaccttctgaatgacctcagcctgtcctttgacgctcggcgcataaaatccgaccttatccgctccgtcgttattgacgccgattccgcgcagcagcgcataaatatggtcgccgtccttaacggcatccgacgcttttttcaagagcacggcgccggctccttcaccgccgatcattccatcagcagccgcgtcaaacgctttaatatgcccgtcgcttgaaaaattcagccccggctgatgaacatatccggcacttgattccgtatgaagggtcgcaccgccgacaagggcatacttggcttcgccggaatgcaggctttgaaaagccgaatgcaggccgattaacgaagatgagcagttggcatggacaaaatagctcggccctttcaacccgagtttatgagaaatcatcgtcggaatcgtgccgctttgggcaagcacccatgatacgtagccatccggcgtttccagctgtgctgtcgtctcctccggcagcaggctgcggtaagagttcgtgcttgcagacatatacacgcttgtttccggaatttcttttgagatatatcccgcatcctcgattgccttccatgaatggagcaaaagcattctcagctgagggtccatatattccgcatctttcggtgaaaagccgaagaaaccgggatcaaacatttctttcccctctaaaactgatttagccggaacgaagccgggatgatcagccagttcttcagaaacaccggatcggcggagctcctcttttgaaaagaagttgatgctttctttgccttctttgatgttattccaaaattcataatgatcttttgctcccggaaactcacaggatataccgataaccgcgacactgtcctcataataatcgggaatttctcccgctgggtgttcccggtcttctgtattcactttcttttgcggcacaggagccaaaacggtttctttcagtttttgttctgtgatgtaccggctgatgtcttttaccgtcgcgtattcaaacagctccgttacactgaattcacaatccagttcctgcgtcatccggtcagtgacagtcacggcaagaagcgaatctccccccgcatcaaaaaagcggtcatcaagctctatatctttgcttttcaatacatcctgccaaatcgccagcaccgcctgctggatatgagatgatgaaaatgtttgtgtgtccggctgcttttccgtcagatcgcgggcagcaagaagcttgcggtcaacttttccgttcggtgtgagcggcagctcttcaagacggataaacgaagctggcgtcatataggccggcagcgcttgtttcaaatgattgcgcaattcctttgcagacggaagcggctctccgtttttcaggatataaaatgcgcaaagtttttcatttccggagtgattgttcacaaccactacgctttcctgtacggccggataggcattcagccggctctcaatatctccgggttcaatccggtagccgcggattttgacttgggtgtccatccgtcccatgtattcaatgcggccgccgggaagaaaacgcgccatatcgcctgttttataaagctttgatcccaattcgagccggtggctgacgaaaacgttatctgtcagctcaggcttgttgaaataccctcttgccaatccgtctcccgcaatacaaagttctcccggcatcccttctaaaacagggttgagagcggaatccataatatacacacgggtattggcgatcgggcgcccgatcgtaagcgcgctctcattttccgttatacgctgcaccgcggaccagattgtcgtctctgtcggcccgaacatattccaagcctcacttttcgtatcgagaaactgctgcttcaattgttcgctaagcgcctctccgccgcaaaggattttcactttttcttcatttgaccatccggaatgaaagagcattttccacgtaaacggcgtcgcctgcatgatcgtcggtttgtactcttgaatcagctctttcagcttccgtgcgtcttttgtgaattctgtcttacagatgttgcactctgctcctttgattaaagggaggtaaagctccagtgccgcgatatcaaagcaatatgtcgtgacggcaagcagtttgtcttcggacgtaagccccggttcattcgccatcgagattaagaaattggtcagcgcccggtgcggaatcatcacgcccttcggtttgcccgtgctgcccgacgtgtaaatgacgtacgccagatcgtcaggtgtcactaaccgcttcagcgacgttctttccgcggctgtactttcaatacgagaccaatcgcggtcaatggcagttgtctgcacgcctccccagttcaaggagtgctctaaatcagctgtcgtcagacacattgaaatcctgctgtcggcgatcatatattccaatctgtcagcgggataagaaggatcaagcggcacatacgctcccccggcttttaaaatgccgagaaggccgacagccatatgcaatgaacggtctgtataaatgccgatgagatcatcagggcctgcaccgtgcgcctgcaaatagagcgccagcttcgtgcttttttcatcaagctcacggtacgtcagcttttgctgttcatacacgaccgcacaagcgtccggcgtttctgccgcctgacgttcgaataattcatggaagcaggcatccggatattcacggcttgtctcattccaagtcttaagaatcatgtgctcctctctttttgtcatgagagaaacgttctcaagcggcatatccggattcgccgtcaaagcttcagcggcctgtacaaattggctgaaaagtctggccgcccctgcttcgtcgaataattcggtgctgtatttaatcgtaagatccatgcctgatgcttcttcccacatttcaaatacaagatcatattccccctcctgatgaatgtcttttacaaactcacaggagaattccttgtattcatccagcatcgattgatagcttgaatactgcagaaagttctgatagaaaaaggcattgctgaaaacaggcgaaccgttctgcaggggtttcgcatgcacatcacgcaccattttcggaaacggataaaaggagtgatccagtccgtccagaacggcatcctgcaccttttgaacaaagtcagcaaatgtttcttttcgtccggctctgctccgtataggaagcatgttgaggaaatggccgaccactccgtcaaagcgttcttcaggtctgaccatcgcaggcatgcctgtcacaatatcttccttatctgtatatttgcttaaaagcaccatatagcagctcagcataacggtagacaaatgaatcgaacgggatgcggcaaacgccgttagattattcagcagccgttcgggaagacggcgtgtcagcgtatcttctgtaaactccggaacgctgctgcccgtgcgcatcggcggaagctgaaggtcaggcagatcgcccccgagctgtttcatccagtaagcgcgggcagctttgctttcttcacccgctaaataccgcttttcccaagccgcgaaatcggaatgaatgccgggagcggcggccgcaaactcttcttttccctccagcagcgcctgataatgatccagcagactgtgaataaatgtaatggatgaaaaaccgtcaaacacgatgtggtgaatgaccgtcaaaagataatgttccgaggcggattttgaaagcagccgcacgcgcagcaaaggcccgccttctttgacaaacggctctttaacttttttccgtatcagagcgggtatttgtgattcattgacgtcagaaatatcttcttccgagaatacaaaaggatctgccgcttctatgaaataaaacccgccgtctgtttcattcacggcgcttttgagcatcggatgctgctttaatacgagctgaaacgcctgtttcagtttctctttgtcgattccggttgtgaatcggaaacagagcgggacatggtatgcagtcgtttcaggcgacattttctgcaatgtccacagccctttttggacttctgaaagcgctggcgccgtttgccgtctctcccgttctgccggcggttcggctttttgggaatgatgctccgctgacatgtttgccgctttttcagcagtataagccgctaaagcgccaatcgtcgggtttttgtgcagctctcttgccgtcagccggatgtgatacgttttttcaattgatctggcgagtttcatcatcttgatggagttaacgccaaggctttgaaacggtgtatttggatcaacaagctcatccgcgatggaaagttcctctttcagaaaacggataaaatcccgttcaatttctttctctgcagaagccggggctgaattgccgccttcttgtctgttattatgtaatgaatcaaattgcccttgttcgaatgaatgtttcagctgagtgcgctggattttcccgattgccgtcttaggaatgtcttcttttgcgaccggaagcagataatcaggggtaacgccgattctctgtgtcacgtgctggtgaatgtgatgaataagcttcgtcatgcggttctcatccaatggaacagacgtcacaaagaaaatcgccagctcatctgtcgtgctttgattcggccggacggcgcatgccgctgtatatgacgtttcaatttccggcaattcctcaacggctgattcaatggcgtggctgtaataattcacaccgttgataatgatggcatctttcgtgcgccccgttatcgtcaggcggccttcacgcagaaatccgagatctcccgtttcaaaccagccgtcttctgtaaagacactctcgtttaagtccgggcgctcataatatccgctcgttacagtcagaccggacacttgaaagcggccgatttctccttcttccaccacttgattgcggtcatccgtaattctcatattaaaccccgggatcggcagaccgatctcgacgaaacgatcgtcgtcactcgtgttttccagtgtaaactcatctgagaaaattacgcccgaagacgtttcggacattccccatgcgggacggatggcattagccggcagaccgtgcggctctaaaagctccataattctgcgtccgactttcgccaccgcggcctccccgccgttcagcatataacgcatggaagataagtcccatttccgtgtttgaatctcttctgcgaaatcggcaagcagcccaaaggcaaaattgggggcccacgtgaccgaagcgcggtaatgatcaatcaggtcgagccattttaaaggatccatcaaaatggattcgctcggtatgttgatttcctcacatccgagataaacatcacgcagatgaagcattccgatgccgccgacatggtcaaaaggcatccagttaaacgtgacatcctcacttgtatagccctgcatctgaatatttcctttgaccatgcagacgatgttttcatggctgagcatcacggctttcggcgtgcccgtgcttcccgaggtcaaaagcagcatcgccaaatcttccggacggggatgatgacagtccgtatccatttcatgcgcactgagatcttctgccgccaaagcgcaaaacccggaaagctcctgctcctccgcccattcagtcatctccggcagcacttcacggcttgtgatgacatacggctgattcaaaagcgtccaggcgtctttcagtttttgcgtcccgctgttcatttctgtataagccggagcggccgcaagcggaaccgggatcgctcctaaaaaaacacagccccaaaacgcaggaatcagctgggaattgtcactgagctgtaatatgacttcatcctgagccttcactcctgattggcggagccctttcacaatcgaaagagcgatctttttcaggccgctgtaagtctggtacactttggtgccgtcaggctgtatatatgtgatgcccttttgatctcccgctgccgcggcggttttgtgcaggacttcaggaatcgtcatcggctgatccgctgaaagccgcaatggttttccgtagctgacagatggcttgagtaacccgcttgccttcatatcacttttcatagagctgcctccatttcatctgtatgtaagatgtatgtcttatactccgtacatcgtcgtgattcgttttttcacttcatcatcatgaaacgtctcatcgtgcatgattaactccttctcaatgacagccggaagctgctcgcgaaacggcgtcaccaagtgccttttcaatgtaattaaagagtttctcggtttttccgcaagctcacgggccaattcctgcgcatagtctaatacttcctgccgcggaagcaccggaaaaggcactcctcttttctccaggtcaccgccgcggtagtggccgccgtttaacagcatttcatggccgaggcttgccccaagcttctccggaacgataaaggtagcccccattccgggagtgaaaccgtatttcataaagtttgcggtatacacgctttctttgcttaaaatgacaaaatcactgaaaagccccatgacaaacccgcctccgattccgtggccctgcatggctgaaataacggggatatcacattccagcgccaaagaatacatgcggtcttccgtaaacttcgtgatgccctgctgaatcctgagcagaccttcctgtgtgcctccggaagcaaagtaatggccgtatcctgttaaaatcacagctttatagactgacgatttttttatacgggtgaatgcttccatcaatccatccgtcagttctttggagaaagcgtttttatgggctttatcctgcattgtcacttggataatatccggttcaatttcgagcagttcaactgcggcgttcggcatgatatcctcctaactgttctccgtttcccaaggaagccgccccgtttctgcataacggaaaatggctgattggttatccggatctgaaaacatcgcttgattttcggctagagcaatggatttcgaacgatgaacaaggtcgtttaaggaatccatgtattttttatagcggatgactgcttttttcgacagcgggcgaagacgcagcaaatgctttctcagctctgttgctgagtccgggacgcatacgtcacaaagtccccattcaagcgcctggcgtgccggcacgggctttgtcatgatcgtcatataatgagccttttgaaatccgattctttgaattaaaaacggcagaacgcaggctggataaagtccgaataacagttcagataaactgaacgaagcactctcctctgcaatgacgatatcgcaggcggcggcaaaaccgacacctcccgcatttacttttccgcggacgcgggcgattgtgatgtacggcccggattttaatgccagccacaaacggtaaagcggctcctgcgattccgcatgctgcattccctgcctcattttccggtacatctcatcaaaatccgccccgaaacaaaatacctccggctgcccttcaagcactacggaggtcacggagtcttcacattcagtaagaacgtgcaggcattcctccactaaacgctcattaatcgtattgttggcttcaggccgatcaaaggtgatgaagcagacattttgctgaaaacggacgttgatcgtctcataggtcacgggatccacctgtatttccgatgaaattccgtgatttcttccaaatataaacgagggctcccggcatgatggtctaaaatgttcggaatcatattcatatccaatttgacattccgggttccgaacttcaccagaccgctgcctttaaacagttcttcatactcttccatggacagcctgtatctgttgttcagatgctcttctattttgaaagaatgctgccgcgtttgtccttcaggcgtcacaacgccgctgtaaaattctgaacagcatccggagccgtacgagaaacagccgatccgcttagaagtgtcgaaagccccttgatcaatcgtgcttgcaagagccagtaaagaggctgcccccataatgtttccgactctttggcagtagcggagccccggctctaccctggtttgaaaatcctgttcgatctcagcgtttttcgcttttgcaagcttacgcatcatcgtccggtgagctcctttgaccatgccgccaaacggtgtatggaaggcaagatagtgaaacgtctctttatagtcagcgcccggcacacggtttttgtactcgcgaaatgtctgttcgcagcaatcgagataagacatcaatgacaagtcggcgtcaccggcttcactgtccgggatcggacggcatgtatccatcacctcatagccgtaatagccgttggcgcccgcatccgcctgaaatacgattgggttttcaccgatcaataaggcgacggcacccgctccggcgctcggttcggcgtaagaccaatcctcgcttaacgcatcgccgccttcggcaattaaaaaccgggaaatatccgtcgcgacgacaagcgccttcgctccgggggatgtctgcgacaaaataaaattaagcgccatctgcaaacccgccgttcctgaataacaggcctgcttcagttcaaataaacggcagttccggttgaggcctaaataatcatgaatatatgtactgagtgattttccgaagtcgatgccggactccgagcaggtaatcagcagctcgattctgtctttttcagcctctgtcaatcggtcgataatcggctttgccgcattaacgccgaatgtgacggggtcttcgtacggaagcgccaccgctttttctttcatcagtaaattctcaaatctggcagggtctaagtttctgtactccgccagctgcatgacatcaaggtatgccgtcccgccaaacacatttatcgcttctattccggcagccgccatgaacttcgcctccaatatgaattttgagtttccgattttttcaccgttttatcagacagcctgtaccttttcataaagctttgccgccaattcgccgatgtttgacactcccgtcagctcaacacgcgggatctgcagtgataattcttcaagcatcatcgtgataatttcggcgcggtccactgagtccgcccccagatcaactaaccggtcttcctttgaaagctgttcgccttctaaatcaggcaaaacctcgtagattgtgttctgcagcaattcaaagattctttcttcactcattgtcagttcctccctgtttcatcttttatgaatattccatgttttcaatctatcatttcgtcttgtcaacacgtttgcagaaatgagcctaacttctgattcaaaagcgaggccgtctcttccataagacgaaggccgataccatcggcatggcggtttttccaggactccagctccgtacctttcacccattgattaaaggcgcctaatgccgggccgcaatgaatctggaagtctaccttggcatccgggtctcctttaatcgccgaagcagagctttgcctgaaataccatttgaatatgagcgccattttctgtttcggattccgttcggcttttgaaatgtcttcattcgaataatgagccttcactttgtcataaatactgcttacacttgccttaaaatacttctcttctatttgtctgagtgtcttttcatcaatttcttcaattgagcggtgacgctgatacagttcatgcagcttagaggcccgggtcggaaagaacagccctttctttaatacctgcaccttgctgcctgattcaaacatatcgccggccggcgcgtaggccgtgtcctgtacattcatctgctgcaggagatcctttacgaggccgctcgtcgctgcttcaacggtgcattggttaatggatccggtcacaataaaatcagcgccgagcataaatgcggccatagcagcctcaggcgttccgattccccctgcggctccgatgcggacggttttgccgtatcggtattttttcatcatgtcatctcgtaaacggatgatcgccggcatgagactgtaagcaactccgccgtcagtgtggccgcctgaatcagcctctacgcagatgtcatgcgcaacgggtatttctctcatcagacttgcttcttcagcggtaattttgttttcggctgcaagtttctgcagaatgtgatcaggcgccgggctgagaaatgcttccgctacttccggacgggacagctttgcgataatccgctgacgcgctattatttgtccgccggcaccgcgttttaaccccttagcgcgaaaccttactaaagcaggagtaaccgttaaaaatgctgatgcttccaagttctgaaccccatgcttcagtaaaagatcaatcattttttcttctgaatctgtatgcttcatgttatgtacaacatttatgccaaaggaaccgccgtcacgaagctcatgctgaattgacaaaatggcgtcctcaacgtgcgcgatgttcaaaccgcccgttccgaaaaagcccatcattcctttttcggccagtttgacgaccatttccttcgaagaaattccgcggtacatgccgccggccaagtaggcgtatttcaattgataatcgcgcttaaactcttcatttcctaaagactccgccgtaattgagctttttccagcttcagccgggactttgatttcatctgttatcggctccgcttcagccgtaattctttgaatcagccccgtcagcacttttccgggaccgatttcctcaaagatcatgttctttcttcccattaaaaaacggatgctgtctgtccagttcaccgatcccgttatttgtccggtgagtgtctttttcagctcggtctgctcataaggtcttgccgtcacatttgaaatgaccggaatggacagcggcttaaaatggaaagtttcaataaaccgtgaaaattcctccttcgcttccagcatgtatctggaatgaaaggcgccgctgacatttaagcggtgaaccatttttacgccgtttacggcttcaaaaacggatgcggctttttcaatatcttctttatatccggaaatgacaatttgctgcggagtgttcatgttggcgatatcaatcgtatgcaagtgatactcccttaaaacgtccgtcacctgctcatgagtcaggccgatcaccgctgccatgccgcctccttttgcgcggctcatcaggtcgcccctttttttgaccagctgtaggccttcttcaaaatcaaaagcgcccgaggcgtataacgcgttatattcgcctaaactgtgtccggcggtaaaatccggtttcaagccggtttcttctgtttttttcaaataactgagggcattgacgacatagagcgccggctgagtgaattgagtctgattgagacgttctccgtcccggcacagctcctgaatggaatatccgagaatgtgatccgcctttgcggttaattcaggatagcggccgaacaggtcctctcccatccctattttttgcgagccttggcctggaaaaacaaagctgatcatcttacagtctccttccgggcggtgataaaatgctgtcttctatttgctgcaaatgggtttgttctttatgaaacggcgtcataatggcacggatgcgttcagccgatcctgcgggaagaatctgtttggcaaatgcggccaacgttccggaaggcccggcatcgatatacaatcctttttggcggctgtctgcgaattgaagcgcttcgcggaattgaatcggctttcttacaatatcccagaaaaagtccgcttgtatatcggtctcagcctctccggtcgcactggagatgtacggtataaacggagtccggattaatttctgagctaaaaagcgcttgtacggctgttccgcctgatcaaccagcgctgagtgaaacccgtaagataccggcaatagctgatgaggaatctgcttttctctcagatcgtccatgatctttttgatatgttcccgctctcccgagatgacaaagtgagaatgatagtttacagatgccaattcactatgttcgccgagcagcggatcatcttgatataaagccggatcacccagtatcgcaagcatgctgccgttacggcaagtttccgtaatgattcgggcctgttccagcacgcaatctaaagcatcctcagcgctcagcacacccgacacagcggccgctgcatactctccaaggcttgctccgatcacataatcgggacgtatgcctctttgctccaaagcatatgcaagtgcgtactcagccataaaaatggcaggatggctgaaaagaaggcggtcaaatggatcagacagacgattgcctgtatgataaacctctttcaggacagagtaaccgaaacggctgactgcaaaatcgtccaagtcaagcattttctgccgaaaagcggcgttatgtgcaaacagctctttccccatttgatagtattgggaaccctgtccagaaaacatgaaaacaattggctggttcatttgttctcctttttgctctttatttttttaaaatattgatttgtaagtttttcttgatgttgtgtgcaggtgaagtggtcgtgatgttgtatggctggcactattatgtgagataagaattttgacttgcgttccgctacatggcgggtgaagcttcagtttcttttttgatgcggtgaataagtcctgtcagcacatggcccgggccgacttcttcaaattccatccgccctttgtccagcagatagcgcatgctgtcgttccatcgcactgaatggtcgatctgatcggccagaacggagtggattccgtcttgctcataaggcctggcatgcacattagaaatgacaggaattgatatagcagaaaaatgaaatgactgtaaaaatttttcgaactcttgttttgcttcgctcatatatctcgagtgaaaagcgccgctgacgtttaacggatgaaacatcgtaacgtcctttattccttcgaatacgcttttggctctttcaatgtcttctttgcgtccggatatgacaacttggtgaggagaattcatattggcaatatcaatcgtatgtaatccgtgcgtttgaagggcgtccgacacttgagctgcggttaaccccataacggcggccatttttccgtcagtggccatactcattaattcgcctcttttacggacaagctgcaggccggtaataaaatcaaaagcacctgctgcaaacagcgcattatattctcccaaactgtggccggccaaataatccggctttatgtcattttcttggatttttttcaaatagcttaacgcgtttacaacatataaagcaggctgggtgaactgcgtcttgtgaagattggaatacggattctcaagacaaagccgtttcatggaatatccgagtgtttcatcagcctgctccgttaagtctttaaattcatcaaacaatgagcttcccattccctgcttttgagaaccttgtccggggaatatgtatgtgatcattttctcagccatcctttctcggattcagttaagaagcatgttcaagttgatagtaacttcacaaaaataccatgtcaagttaatttatcctatgcggaatcctgaataatgcctatttttccctgacggaaggcggactcagggcttttggaatagacataagcagaatgtcccattcagcctgcccggcgcttttatccgcaaactaccgttactcagccattcatcaccaaaaagcgagcaatgactatcatttcaattcagaagttccgtggcctaaaagaaaaactagttagatagaaccaaattatacgctacttaaagtgaaacagccctttttgattttttctgttgcggaaattcacgaaatgttcttttttttcaatctgaaagtaaatattgtttttcaaaagactctccattttttgacccggcttctccccgaaggagtgccccggatacacacgcacatgcggcggaatagaggctttgatcctctgtatactgtgaaacatatcttcagctgagctgcccctgtcctcacatataccgcacccttctgtaaacacggtatcaccggtaaaaaggtgatcagatagcaaatagcacattcccccggccgtatgtcccggggtcaatatacttctgatgataaaccctccggccgcaaaggtttgtccgtcttcaagcgctattaagtttctgcaccggaattgatagaaatcgatttccgccgacgacatgtatatatcagaatgatagatttgctgaagcggctccgccaagtttacatggtcataatgcgaatgtgttaataaaatagctgataaatcaacatccaattcatgcagtttatcggttattttatcgatttcccaggacgggtccaccgctatcgcagatttttttgagcggtctgcgataatataacaatagttggaccacatctggtgataagttttgatttgatgcacttcatatgtatgatccattgtcaccattcccatttaaaagatccgggcagactgctgccgccgcccagccgactgtaaccactttaccagatggcaccacgtttttccatggattttccggtaaagtttaaaaaactttctgctcccgccaaaagcaccagtctgggccttttttacaaattgctatgctgatatataaggaaatcagaatattaattcagatgaattctttagggaattttattcagaaaatgaaggatgaatatgagtttcggataaaaagaaaacaaattgaacttttgttttgagaagcaattacagaagcggccggaggagataatcagtttttagaaatgacccgcaattaagattattatttcaatccttttcttcagataaactaaaccacacgggctctcgaaatatatcagaataccttagttcttacaccgaattcaacgttatgttgacattaacataattgaactgagaaaagtacagcttaatttacactctttttttttgcgagaaaaccgttcaaaaaccagtctagctgcaacaattcacgaaagcgtcgcgcatgaaaaaagacgtcagttgaagacgatttatatttgattattgacaaggagctcagatgtttttgttagggctaaataaagttatctttttactgtgtaaaaagtaaatattaagatttagacaaatagactatgtgatatgggtcggagtttactgttcaaggtgatttgtcctgagctataaaagcactgagagcagctcgggacgcaatacctactaaagttaaagctgctatgggtggaatcggcggttttgaaataattcttaatatcattgacaattttactggtgcagttgaagatgcgtgctatgcggatgctctaaaagtaactggtaaccaggcagcaactttgtgggttactaaaactcttatgcttttcctttaaatggggctattgttggtgtttaacaaatttatcctgtgttaagctttaaagtgattattttctaaagtgtttaagatcggaggtaactatggaagataaaagtaatgctgaaccgagcccgaaagctataagaattctaacttacatcattcctataattttaatagggcttatccttgtccttaagaatattaacaccgccgcagcggaaatttcattttatattgttgctgtcggtgtggttctcttagtggttttcagtttgatcaaaaatagaaaataccgcaggaagaactaaatgtaagggggctaatcactagtcccccttgactgacttgcggatagtataacccgccaaattccaattttatttaaattcttccccatctcttccctgtgactttgtaaaagcaggtacccgcatacagagtattcatcttgtacttcagggatccttcccaaataactggatgttaaacaaattatcttcatgatttacggtataccatgcaacaattatgccagaactcaaaagttatctctgaaaggctgggtcattcaaactagtaaggctgcttgtgggtaaataacagtttagtctcacataaacgttgttattacatcacacgcttaaacatcttctccatttcatacgtactgtggtggataatgatcggccggccgtgcgggcatgtgaacgggtctgtcgttcggcgcaggtcgtccaagagcgctttgatttcgtcgtttctcaaatggcggttcgctttgattgagcctttgcagctcatcataatggccgcttcctccctgagttttttaatatcgatctgtttggcgtcaagcacctgctgaatgatttcttcaatcagttcagcttcttccccttttggaaaccaggccggatggcagcggacgatgtagctgttcgtgccgaatgcttctaaaaatactccgacgctttcaagctcatgctgatgctggtcaatgatcagcgcttcatttgccgcataatgaaaggtgagcggcacgatcatatcctgcacttcaggctcgacctgcccgactttctcccggaaatattcgtatttaatccgttcttgcgccgcatgctggtcaatgatatacaagccgttttcgttttgggctaaaatatacgtcccgtgcatttggccgatcggatacatcaccggaactctttcttcccgtatttcttcagagtcagcctcctcttcaggctccggaatatcggaaacaggcgcttccgttaccggcatgccgagctccggcggcactccgtgacctgcttcatccggcagggactcttcttctatgaccggctccggctcttttacgaccgaactcagcttcatcggtgagtaagacggctccggcgttttttcaggaagtttccgctcaggcgcgctttcctcgaatgtcataaattgctgttcgtttttggccggtgccggcgctgtttttttcgggagctgggcgctcggaataagccgctgcttttgaaacacttcctttatcccgtcacggatcagctcatgcagctccgtctctttgctgaggcggacttcaagcttcgacggatggacattgacatcgaccaaaatcgggtccatcgtaatttcgataaacgtaatcggatggcggccgatcggcagaagtgtgtgatagccctcatgcaccgcttttacaagcgggaaattcttaatgtatctgccgttaatgacagatgacatatagtttctggatgcacgcgtgatttctggaagcgcgatgtagcccttgacttcaaaatcaagcgagctgacatggagcggtatcatttttttcgcaaccgccgtcccgtaaattgcggccagcacatggcgcacgtccccgttaccgtttgtctgcaacagatttttcccctgatggcggagacggatggatacttccggatgcgcaagagcaatccggttgacaacatccgtaatattgccgagctccgtatgcacggttttcatatatttcaatctggcgggcgtattgaaaaacaggttggtaacgataatctccgttccttttctgctggaggatttctgttcagaaatgatattcccgccctgaagaatgagatgggttcccgccccctcgccgatgctcgttttgatttccagatgagaaacagacgcgatacttggcaaagcttctccgcggaaaccgagtgttctcacccggaacaggtcgttttcatctttgattttgctggtcgcgtggcggcggaaagcccgcttgcaatcatcggtttccatcccttcgccgttatcgagcacccgaatcgacgaaagccccgcttcctctatgtcgatttcaatgactgtgctgtttgcgtcgatggcgttttccaccaattctttaacgactgaggcaggccgttcgaccacctcgccggccgctattttattcgaaagttcatctgacagctggatgacttttgccaagtccgtcacctctttctattttaattttttttgcagcttgtacatttcattcatcgcctcaagcggcgtcatatcgagaatattgattgacttaaaagcttcaagcacttgtttttctttattagaaacagccggtgccttctgttctttttcaccgtcagcaaaaaaggacagctgtgccggttcttctttgacggcgggctttttctcaggtgccgccggaagctccggtttatctcccgtctgctcaagctgtttcaaaatctcctgcgcgcggctgatcagatcgtccgggagctccgcaagctgggcgacatgaatgccgtaacttttatctgcggctccttctttgatttgatggagaaacacgaccgttccgttatattcctctgcgcgcacatgaacgtttttcagctgaggaagcttatcttcaagcaccgtcagctcatgataatgcgtgctgaatagtgttttagcgccgatatgatcatgaacatattcaataatcgcctgtgccagcgccattccgtcgtacgttgatgtcccgcggccgatttcatcaaacaggatcaggctgtcttttgtggcgttcacaatcgcgtttttcgcttccagcatttccaccataaaggtgctttgtccggaaatcaaatcatccgccgccccgattctcgtgaagatttgatcaaaaatcggcagaaccgcttcttttgcgggcacaaaacagccgatttgggccatgatcgatagaagtgcgatctgtctcatgtacgtgcttttacctgacatattcggacccgtaataaggagcatttcccgcgaatcgcccatcaggcagttgttcggcacgtattcttgactgtccatcaccttttcaacgacggggtgtctcccttcaatgacttttacttcattatcagaaaagacgggctttgtgtaatgcctgttttcactgatcgtagcaaagcattgcagcgcatccagctcactcatttgtttggcaagacgctgcagacgcggaataaattgtttcaccttttcacgcagaccggcaaaaagctcatattccagctcgcagatgttgttttccgcttctaaaataagcgcttctttttccttcaattccggcgtaatgtaccgttcggcgtttgtgagggtctgcttccgctcataccgcccgtcctcaagcagatgaaggtttgcttttgtgacttcaatataatagccgaacactttattgaaaccgacctttaatgaacggatgcccgtataagcgcgttcctgctgctccagtctggcaatccagtctttaccgtttttgctggcgtcacggtactcatcgagcttctgatgatagccgtctttaattaagttgccttcttttaacgataacggcgggttttcatgaagggcttcttctaacaggtcaagcaaatctccgcacggatcaatcaagccggcgcgttcttttgcttttttatggttaagagatcctacaagctctttaatgctcggcacttgttttaaagattctttcagctggattaaatctcttgcgttgacgtttccgaatgcgacccggcccgccagacgttctaaatcgtatacttccttcaggcgctcgcgcagatcttcgcgctcaaacagatgattgatcagcgtctcgaccatttcctggcgttcttcgatttgggatgccctgatcagcgggcggtcaatccattgtttgagaagccggccgcccatcgctgttttcgtctcgtctaaaagccaaagcaatgacccttttttgcttttcgaacggatcgtttccgtcagctcaagattccgttttgaatacaggtcaattttcatcgcttcttccaattcatatacttgaaccggctgcagatgatccaggctccgtttttgcgttttctgcaaatacgtatataaacgcataaacgtctctgtcagctcttcgcccggcaagtgctttgcgatttcaatgcgttctgttatttccccgtcttcgatagaaatcgttgcgccgcaccgttctttcagctgagcagccgtatgttcgttaaacttgcttgatacgacaatttcctttgcgccgactgagtaaatttctgacatgacatcttcaatccgctcaataaatacggccaggttttctccggtcgttaagtctgataaagcgagaccgtatccgttacgaaattcggaaacggaagcgataaagttgttttccgactcatggatgccttttccatccatcacggttcccggggtgatcagctggacgacttctctttttacaacgcctttagccgccttcggatcttccgtctgctcacagatcgccactttatagccctttttaatcagctgttcaatataagccgccgcggaatgatacggcacgccgcacatcggaattttatcagccgaacctccgtctctgcttgtcagtgtaatttcaagctcttgcgacgctttttttgcatcttcaaaaaacatttcataaaagtcaccaagccgaaaaaataaaaaggcatcttggtgctctgcctttatcttcaagtattgctgtatcataggcgtgtaactagccatcatttaatccctcactatgtatcttctcttatccgaatcccattataacataaacaaaagagtgatatctttatatataaaaaagagactcggggtgttaaactcccctagcctcaacttattcttcaggatctccgactaaaaattcagggttaatgtcctctaattcttcgtcaagatcgtcttcccaatcatcatcatcgtcttcttcccagtcaggattgacttcgacgacgactttcgtttcaccgaccacttctgctaaaaattccctctctgcctgaaccacgattttatttccgttaggagaaatggtgacttcaagacaattcggctgctgcagcactttggcaatgacttcgtgttcgtcatctaagtaatttgtatctctgtatctgagtttaatcacatcgacatactttactctctcggttacaacttccgtttttgtattatcggcgtaagagtaccagacgtttatatcataatacccttcaatttctacagtcttcccgatcttttcggcatcgtacttgtggttgataatccagccgcccagtatacttgacggtttttctccaggcgagatcgtgttggtgcattgggtgaattttcttcctttcgcaactaccgctttcgtaataatttccctgtattcagacattccggcaggcctccttgttcttcttcgtgttatcttatgctgggcatttgtctcatgtgcatttttataataaaaatataaaaatacaaagtttctgtttcattgtatgcagccctgcccagaaactttacttttaagtatgataaaactttccagtaaaaataggacaaaacgttgagacaatgaaaatttagtacatattacaattagttcttaaacggcaaaaaaaacacgggccgatgaaggccccgtgtttaaatagaacagctgttattcgaatgttttacttttgaaccggtttctcccgtcagcaggttgcctccggtagatgtaatgatttcgtttgtcacctgatttgagatcgtatgtgcgacaagctgaagaaggtcattgacctcaatctgggaatctctgaattcctggatgatcggaatcccttcaagctcttcctgcagggcgtcaattttactttccacttgtttcagcgcttcaagcttttcgtagtgcttcaggttaacggcttgcttttgcagggttttaatctgattaataatcgcagagactttttcattttcgttaatctgcgcctcggcgcgtttgaaaaaatcaacttcttctgtttcagaaatcattttcgcaaggttcctagcctgctgtacaatgtctttctttgagtaaagcgtcatcattatttcacctcgattgcttctcctgccatcacaccgtcaagcgaccatgttttcgcctgttcgattttgacgcgtacaatcttgccgatggcgtctttcggccctttgaagttgacgagcttgcttttttccgtatagccggcaagaatgtcagggttatttttgctttctccctcaactaatacttcgacagtcctgccttcatattccttcatttttttggctgaaatttctttcaccaaatcattaaggcgctgaagacgttctttcttgaccctcatcggaacattgtctttcatcttcgctgccggcgtgccttcacgaggagagtaaataaacgtatatgcgctgtcaaattccacttcgcgatataacgaaagcgtttcttcaaattgttcatccgtttcattcggaaaaccgacaataatatcggtcgtcagtgaagcgttcggcatcgccgctttaatttttccgacaagctccagatagcgttctctgtcatatttacgggccatcatttttaacatcgctgagcttcctgattgaaccggaagatggatatggtctaaaaggttgccgcctttggcgagcacttcgatcagatgatcatcaaagtcacgcggatgactcgtcgtgaatcggattctcggaatatcaattttacgcagttcgtccattaaatcaccgagaccgtacgtcatatcctcaaaatcttttccgtacgcattcacgttttgaccgagcagcgtgatttctttatagccttcgcttgcaagtcttctgacttcctggataatttcctcaggacggcggcttcgttcttttccgcgggtatacggtacgatgcagtatgtgcagaacttgtcgcagccgtacataatgttgacccagcctttaatttttccgttgcggactttcggaaggttctcaatgacatccccttctttcgaccacacttcaatgaccatctcttttgataaatatgcctctgataacagttccggcagacggtgaatgttgtgcgtgccgaaaatcatatcgacaaacgggtgcttcttaaggatgcggtttacgactgattcttcctgtgacatgcagccgcagacgccgagaatcaagtccgggttattttttttgagcgcctttaaatggccgagctctccgaacactttgttttcagcgttttcccggatggcgcaagtgtttaataaaataacgttcgcgtcatcaaccgaatttgtcgcttcataaccgagcgccataaaaatacccgccatgacttccgtatcatgctcgttcatttggcatccgtacgtgcggatataaaatttcctgccttcaccaaggcctttaaattcttcagagattttaaaatcgttatgatattgaacggattctttgccccgttttttcgcatcttttaaagaaggcggaatatatacggcttcaaaatacttgctgtaatccttttcggattttttgtccgccggattcacttgtccgctttcctgcttttgcttttcattcatgttcgaatgtctcctttcaaccgaaacttccaccctcaagtatactggttaaaagcgtttggcacaaccgccagcctattattgtacaccttattgagaataagaatcaataagaaataaaaaagagggaatcatttcccccttacacaagctgaagctcttttgcggctgaacggattacttccagggcccggtcaagctcctcttttgtatgctccgccgtaataatggtgcggattctcgcttttccttgggcgaccgtcggatacacgatgctttgtgcaaacacgccgcgggtcaataaaaggtctgataatgcctgggctttttcttcctcccctattaatatcggcacgatcggtgtttcgctttttgtgagggtcagccccatttgaaccagtttgtctttgaaatacgccgtgttctcccatagcttttccatatgctcaggctcttccagcaggacgtcaatggcttctatgcatgcggccgttactgcaggcggatgagaagtgctgaataagaaaggacgccctttatggcgcaggtaatcgatcagaacctgcgaccctgcggcgtaaccgccaagcactccgatggctttgcttaatgtgcccacctgtatgtggactcttccgtcaagcccgaagtgattaaccgtcccccttccgttttttccgagtacgccggaagcatgcgcatcgtcgaccatcacaaaggcatcgtacgcctctgcaagtttgacgatgtcaggcaaaggagcgatgttgccgtccattgagaatacgccgtcggtgacgatcaggcgcatgcggtaattcattgattttttcagcaccctttccaaatcgtccatatcaacatggcggtacacctttttatctgcttttgtcagcctgatcccgtcaataatggaagcatggttcagttcgtcagagatcacgatatcttcttttgtaagaatgcttgataagacgccctgattcgttgtgaaccccgattgaaaaacaagtgccgcttctgtttttttaaaggttgccaattttttctccagctcattgtgcattgtgaatgttccggcgattgtacggacggaccccgtacccgctccgaattcttccgcggcgcgtttggccgcttcgacaagtcttggatgcgacgtcaaaccgagataattgttcgatgaaagctgtatcacgttttcccctttgacttccaccgacggaccctgcttcgtttcaatttgtttcatttgctgccacgttttattttctttcattttatcaagctctgcttttagaaattcaaattctttcattatagaaccctccccttatggaatcaaaatgactttgccgcactgtccctttctcatcaggtcaaaccctttttcaaagtcttcaagcggaaactgatgcgtgatcaccggcgtcagatcaacaaggccggattcaagcaggtgcgatacctgccgccatgtttcaaacatttttctgcctgtgatgccttggacggtaagtcctttaaacaccacgtcatttgtcaggtcaaccgtcaccggacgttccggcagactcagcatgtggaaccttcccccgttggccgccatctttaatccttgtgttatggctgccgggtggcctgacatttcgcagacaaggtcgatcccttcaccgcctgttaaggtgtcgatcacctcaagcggatcttcctcatcaactgaaatggtgatcgcagctcccaatttcttcgcaagagccagcctgtaatcatttttatcaatggccgcaatacgggatgcaccggccgctttagccaccgccaccgccatcagcccgatcggtccgcagccgataattgcagcggaaccgcccgcaagccggctgctttccagcaccgtatgcaccgcgttgccaagcggctcttgaacagaggcgacggcggggtccatatcagcggggtttttccaaacatttcgggccggcactttgacatattcagcgaaggagccggctgtatctacgccgaggatctttgtatgggtgcacacatgatgtttttctgttaaacacgggacacaagtaccgcagacgaagtgggtttcagccgaaacgtagtcacctattttgacatttgtgacgtgcttgcccgtttccgctacgataccgctgaattcatgtccgaatacttgaggtgttttgattcgtttctgcgcccattgatcccaattataaatatgcacatctgtaccgcatatagatgcggcctgtactttaatgagaacttcattctcattaatggaaggtatgggaatttctttcagcgttgctccgaaagcgttttcatttttaacgatagctttcatctttcctcccaacatgtacactcctcctcgaaaaaacactgtaataactggattgtaacatgagataaaaaggaggtaaacaccagtgtccactcgaggaaaacaactgcttccgtccggaaaaatgggcgggattttttttgaatattatatgaataaagccatttatcatctcttcgtactatcaatataatattgtgagaaaatatgacagcaataaaaacaacctgctcgccttacgcaagcaggttgagaatgtacatatttttgtttttaacggggttcgacgattaacttaatcgccgttctttcttctccgtcaatctgtatatctgtaaaagccggaatacaaatcaaatctacgccgcttggcgcgacaaagcctctggcaatcgcaaccgctttaacagcctggtttaaggcacccgccccaattgcttgaatttcggcggctccgcgttctctcaatacgccggcaagcgcgcctgctactgaatttggacttgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttctactatattcactaagaagttgctatattcctgcttttccttttaatatttttataaaataaacacatgatcacctattcaaagaacatatggtcatcattgattaatatccgttcgatatttacggcctttttcgtttgatcgtcgatgtcaatgagcactccgctcagcgtagttttaccttccgccaccgtaaaccggacgggaagattggttttaaaccgcttgatgaccgtttctctgtccataccgagaattccgtcgtacggacccgtcatgcctacatcagtaatatatgccgttcctttcggcaaaatgcggttatctgccgtttgcacgtgtgtatgggtgcctaccacggcagaggctcttccgtctgtataccagccgatcgcaattttttcgcttgtcgcttccgcgtgaaaatcaataaaaatgtacggtgtgcgctttttcgcttcttctattaattcatccgctttagcaaacggatcatcaagcggcggaagaaacgtccgcccctgtaaattaatgacggcaagctcttttccgttcgatttaatataagtaatgcctttgcccggcgtaccttccgggaaattcgccggccggacaagatgcggcacatcatcaataaagtcgaagatctctcttttatcccacgtatggtttcccattgtaatggcgtcggctcccgcttccatcaggctgtggtagatcttttccgtcagtccttttccgtgtgctgcattttctccgttaataattgtaaaatgcggtttatgtttcgctttcagtttcgggacatattcttttaccatgtcgcggcccggggaaccgacaacatctccgataaataaaattctcatacattccattccttccttttcagggactcaaaaaaataaagtgatgcgctaagcatcactttattttgcatactctacggctcgagtttctctgatcacggtcactttaatgtgtcccggataatcaagctcgtcctcaattcgtttacggatatcacgcgccaaacgatgggcttctaaatcattaatggagtccggcttcaccatgatgcgaacttcacggccggcctgaatcgcaaatgatttttcaacaccttcgtaagactcggagatttcttcaagcttttcaagtctgcggatatagttttcgagcgtttcacttctcgcgcccggtcttgcggctgacagtgcatcagcggcagcaaccagaacggcgataatggaagtcggctcttcgtctccgtggtgtgacgcaatactgttaatgacgactggatgctctttatatttggtcgcaagctccactccgatttccacgtggcttccttccacttcatggtcaattgcttttccgatgtcatgcagaagaccggcacgcttggcaagctttgcatcttctccaagctcggaagccattaaaccggctaaaaacgcaacttccatagaatgtttcagtacgttctgcccgtagcttgtacggaatttcaaccggccgaggatcttgatcagatccgggtgaagtccgtgaacgccgacttcaaacgtcgtctgctcacccatttcccggatatagtcatcaacctcacggcgggatttttcaaccatttcttcaatgcgcgccggatgaatacggccatcctgaacgagtttatcaagagcgattcttgccgtctcccgtctgatcggatcaaatccggaaagaatgactgcttcaggtgtgtcatcaataatcaggtcaatacctgtaagcgtttcaagcgtacgaatgttacgcccttcacggccgatgatacgtcctttcatctcatcattcggaagattgacgaccgataccgtcgtttcggcaacatgatctgctgcacagcgctgcaaagcaagcgacagaatgtttttcgcctttttatctgcctcttctttcgcacggttttcggtttcttttgtcatgatggcgatgtcatgtgaaagctcattttcaacccggtcaagaatgatttgtttcgcttcatcccgtgtcaggctcgaaatgcgttcgagttctgactgctgcatacgaatcatctcatccactttgctttccatctcttcaatatgttgttgtcgttcattcagagaatgatctttcttctccaacatcgcttcccgtttatcaattccttcatgtttacggtcaagattttcttctttttgaagtaaacggttttcttgtttttgaagctcatttcgtctttcacgaacttcctgttcagcatctattcgaagtgtatggatttcgtcctttgcttcaagcagagcttcttttttcagtgcttcagcatcacgctttgcatcttcaaggatttgctcggcagcaccgcgtgcgcccgcaatctttgcttcggcaatggttttacgaacatagtagccaacaactaaaccgagcagagtcagcaaaatggagatgagaaccgtcattggggtcatactttcacctcctcttgctatgaacttggtttttgcttaaataagtgccggcatgtacattgtctgattttctcaacatacagaaccttcacagggaatgagtctctcatgcccttgtcaagtttaaatggtttaacaatcatgttaaaaaaacaaatgttacaacttcattgtaattgtgtcggaaatacttgtcaagcttgccagcttaacgattcgccttcagctcggatcgccgcccatgtatatatcataccataccttcatccgcttttcgtgaatgacggctctgtcagtccgcctggttaagcaattggtaaattctattgtttacctgtcctaatttggcgttattctgaatgtttgacagtaatatgacatatttgcttgccgaatggctgaaactgtttaaaatgttgtaaccgggcataacaccgtgattggaatagctgcccggatcaatgtaaaaccccatcccgtaagcggcactgcttcctgctgtaaacatttttgtgaagctttcttttgaaaggagcgtgccgtttacgatcgctttatcaaatttataaagatcttcagcgctcatatacatgtcgcccgccccgtaaagctgcgataagtccaaaaggtgcggcgttacaagactgccgctctcatcgactttgtagccgacggcaggatatttggcttcagcaaatgttttgtaaaatccggcatgcttcattccggccggtttgaacacgtgttcttttatatattgttcataagactccccgctgacctgagatgcgatataagcaagcactgaatagttggaatccctgtaatcccaaaccccgggctgccttttaattccgcggtattctatatccttgattaaatcaattggagaaatcggtccccgaccctcaatatgcccgtttatgccggacgtatgattgagcaggtttttcaatgtgatgcgcgtgccgttaggaaaattcggcaagtatgtactgacggggtcactcgtctgcagcagccctttttcttcaagctgcaggacagccgtcgcgattaacgctttttgtgaagaaccgatataatatgatgtctccggattgtttttaattttttgttttcggtctgcatagccaaagccttttttcagcacaacttttccatcttttacgatcattgctgtgccgctgaacccgatctgttgcaagtaattgctgatctgtttattgtgatcgattgatttaggtgttttctctttttgcgtcttttcttttttctgttgagtctggtcttttgaagtatcagattgagcggcgggagcgtttttaacggattccttctcccgatgatgcgctgtgacggtccagatcataataaaaacagtgacaagcagcagaaaaagaaacagccctcccgttttcatcagcttcttctttctttttttatttattcttgtgcggcgggggctcgtcatcttttttcctcctcagatataatttcaactttcgccatgatgttagacgagtgaagggtgaaaaaagttgtaacattccagataaaattttccgaaacagccagtgtttttttgaaacatacaaaaaaaagagcggaaattgcttattccgctcttttgatcgtgtttttattcttctaattccatctcttcctgaacttcttccgctttgtccgttacaccgttattgtctaaaccgtaatattcacggatttgttcctgaatcatcagcatgatgtctttattttcttttaagaactgcttggcgttttcacggccctgaccgaggcgttcttcttcataagaataccacgaaccgcttttttgcacgatatccagttcagttccaaggtcgatgatttccccttctttggagattccttcaccgtacataatgtccacttcagccgtacggaacggaggagcgactttgttttttacgactttaattctcgttttattccccatcacgtcgttgccctgctttaattgctcggcacggcgcacttcaagacgcacggaagaatagaatttcagcgcgcggccgcccggtgtcgtctccggatttccgaacataacgccgactttttcacgaatctggttaataaagattgcgattgttttagatttattgatggcgccggaaagcttacggagcgcctgagacataagacgcgcctgtaaaccgacgtgtgaatcacccatgtcaccttcaatttcagcttttggaacaagcgccgcaacagagtcaacgactacgatatcaacagctccgcttcgcaccagcgcttcagcaatctcaagcgcctgctcccccgtatccggctgagaaagcagaagctcttcgatattgacaccgagcttttgcgcgtaaacaggatcaagagcatgctcagcatcaataaatgctgcctgtccgcctttttcctgaacctcagcgattgcgtgaagcgctacagtcgttttacctgaactttcaggtccgtatacttcaataatccgtccgcgcgggtatccgcctattccgagagcagtatcaagtgcaagggagccgcttggcaccgttgaaattcttgtatccgttttttctccgagcttcatgatggaacctttgccgaattgtttttctatttgcttaagagccatatctaaggctgcctgacgatcactcatttattttttcctcctttatcttgccactacatatactataccttgtttactggcatttgccaagaaaaaagcgaacgcatattcggattttttccgcgttcgcttttctgcaaaagagcataatttcccttatgaaacttaaaaatcagagaaaaaagctctttaaaactttatttttgatccagcatttttaaaatgagatggcagccgtatttagcggcgcgctttctgattccggttcttgagccggcaaagtgaaattcgtgcacctcttcttttccttccgctgaaatgccgataaagacgcggcccggcgcatgcccttcctgcgggtcgggacccgcgaccccggtaaagctgatgccgatatcgcttccggtcagctttctcacaccggatgcaagctctttcgcacactctttgctgaccgctccgctttctgcgagcgtctcagctttcacgccgagcacatgctgtttcacgctgtcggaatagcagacaacacctcctgcaaatagttgagacgcaccgcttaaatcagtcacccactctgaaaacaagccgcctgtaaagctttcggcagaagaaatcgtgattttgttttgtctgcatgcttttgaaagctccttcaccagggacgtatcatcatatccgtagaaaaattcaccgacacgttctaaaatggcggcttccgtttcttttaaaagccgttctgtttctttttcgtcagcatgtttcgccgttaaacgcagcgtgacctcgccgtcagcagcaagcggcgcaatcgtcggattcgtctgcgcgtcaatgatatcttctaaatcagcttcaagctgggattcaccgattccgaaaaaccgcagcacggttgaaacgattttctcattagaaccaagctttttaagaagcagcggtttcgcttcattttcaaacatcggacgcagctcgctcggcggcccgggaagcagcatataaagccttgagccgtgctctgcaagcattcccggcgccatgccgaaatgattcgccaaaacgtccgagccctcaatgacgagcgcctgtttgcggttattcggcgacatggtccgttttgttttcgcgaaatattcttcgatcgaccggaacgcttcgtcattcagaacgagcgggcgccccagtgtgtttgcaatggtttctttcgtcaaatcgtccttggtcggtccgaggccgcctgaaaaaataatcaggtctgagcgctcttcggcaatgcggatgacttgcttaagccgctccggattgtcaccgacagcggtatggtaaaacacgtttacaccgatttccgccagttctttactgataaactgcgcgttcgtattggcgatctggccgagcagaagctccgagccgaccgcaatgatttctgctttttttgctatttccatctttaagtccttcttccttagttagatgtttttaacgcatcccagttcttcgcaaaataatcccagccggaaatgactgtgaagagcacggccacccataaagcgatatcgccgaacgggaaagaaacgagctcaaacggaagattatgcagcaaaagcgcggcaacagcgatgatctgggcccatgttttaattttccccagcatattggcggctacaacttcccccgttcccgccagcacaagtcttaatcccgttacggcaaattcgcggctgatgatgatgatgaccatccacgccggcgcaaggtcaaattgcacaagcgtaattaatgccgcggacaccagcagtttgtcagccagcggatctaaaaatttcccgaagtttgtcacgaggttcagttttctggcgtagtagccatccacccagtcagtcgttgatgcgataatgaacaaaacagctcccgtaagatgcgcgaccggaatcgattcatcccctatatgaacgctgccccaatgaaaaggaacaagcatgataatcataaatacaggaattaaagcgattcttgccagtgtgattttattcggtaagttaaacataaagcccctccaataatatgtactcggacgtgaagaaaaagtcatcttaatcgttcagatgactttttccccttttattttttcatcttgattgtgatggtctgcgccatcatatcatgcggattgagttcataggacagaacctctccgttgattttaattttcaggttaggggcatagcccgtgcggatttcaatctgcttttgatccgtgacgtcttttttaaaggtttcgcctttttgcagcgttccttcttttaaagaaccgccgctgtcatcacggacgcggatccatgcgctgtcagaagcaatcagttcaagcttatacttatctgccccggagacgttgtatgaagaagccgagccttccgttccggccgctttgatctccgtcttttcactgcttttttctttctttttctgctctgacgcttttgtgtcttttttgctgtcagattgcgcttcgtcgtttgtattgccgtcgtttttcagcgcagaatccttaggaatctcatacttgctctcactttgggtgacggccttatctccgtctgtctgcccggatttgctcattccgaactgaataatcgcataaatgatcgcgatgacgataatgacaccgatgacgacaaggacggtcggaagccattccgccgcctttgaagcggacttaggaagctccctttgcatggcgagaccggagattttttccgacacatcgtcatggtacgtgttagggatgtcttttttatattcttcgaataactgatctgaatcaagcccgacagcttcagcgtactgcttgataaacgcccgcacataaaaattgccgggaatgacgtcataattgccttcttccagagcggttaagtatcttttctgaattttcgtcgccgcctggagttcatccaatgacatccctttttcctctctggcttctttaagccggattgctaattctgtcacaacaaacaccttccaatattaaaaatcaaagcttgaaaaaccggtctggtcaaacatttgcggttcttctgcatgttcatatgtaatgacttcgtcaggatcatttctgagttcgataatataatcgaaatcatcgagcgtatactccgaattttgaacaaaaatatcggggtgctccacgacctttgtcgccggaagccgcataatttcactgacgagctgaagatggcgctcagatccccgtcttgtcgaaacgatgccgtcgaggataaacacgttttccgtgctgtattcatcggcaaccagctggctccggatcgtttgttttagcagcgttgatgatacgaaaagccatcttttgctggcacaaacgcttgacgcaacgatggactccgtctttccgaccctcggcattccccggattccgatcagtttgtgcccttcttttttaaacagctcggccataaagtcaaccagaagaccgagctcgtccctttcaaaacggaaggtttttttgtcatcggcatcacgctgaatgtatcttccgtggcggactgcgagacggtcgcgaagcctcggttctctcaacttcgttactttaatggtctccattgtttttaaaattgattccaatcgtttaatttgatctatatgccggcatctgagcagcattccccttctggaaaggtcgacaccgttaattgtgacaatattaattgacagcatcccgagaagagatgaaatatccccgagcaggccggggcggttcacttgaatttcatattcaaaataccattcgagctttgccaaatgatataccccctccattgtggcaaatttttaccttcctttatcataaaacatttttctctaattagaaagaagaatgttgctctatagaggaaaacataaaaaaagagaggagaaatccccctcttaatgagtgctgttattttcaacaagcttcaccatcatatttgcgatggcgcgctgttcatcttcagaagcaacgctccaaagatcagcaagcactttttcctgatggtttttcgagtcgacttcgttcgcaaggtaaccgccgatttctgtcgcgaggtcagtgatcgtttcatcactcatccctttttcctgcgcatagttcaatctgtcgccaaggaaattcttccaattatcccagttttctaatactgacatgttgggttcctccatttcatctgttgttacaaaattattttgtccgtgcagatgcaaactatacacacatttttttcagcagtgccagccgccgtttacggataatatatgccccgtaatataggaagccttgtccgataataaaaaggccgccgcttcggcgatttcctccggcttcgccagccggcccgcgggaatttcctctgccaacgcttctttttcatcagacgtgaactgatcaagcatatttgtatcaacggcacccggcgagaccgcattcacgcggacgccgctcggagcgagctctttggcaagcgctttgacgaacgaatgctgcgctcctttgaccatgctgtataatacctcgcacgatgcacctgtttctccccagacggaaccgatcgcgacaatgcccccgctttttttccggatcatgccgggcaccagattacgcgccaaaagaaacggactcgtcacatgcagctgcaccatctcccgcgccgtgtcatccgtaacgtccgtaatcaggccgaaatgacttttgccgctgtttaatatcagagcgtccacaggctgcttaacggaacggctgagtgtctccgcgccatccggtgaggacagatcagcctggatagcggaggcttttacgccgaatgatgcgctcagcctttccgcaagcctgtgtgcggcttccttattagaatgataatgcaaaaggacgtcatatccgttttttgcgaggacttcacttatactttgtccgattccgccgcttgctccggttacgagcgctgtctgtttcatcaatcaatactccttctttccccagaaaaacatccctcagggcgtgagggatgttttgttatgattttggcacgactttgcagactgtcagcctgtcttctgatatttcttctttaatgacccgctttacgtcttccagggtgatctgctccagtacggttacgacatcaaacagactcatatctaaaaaggcgtagcgtgtgaattggttggcgatgtattcaggcgaattgagcgcttttaaaaatgacccgatcttcttttttctcgcaaggtcaagtttttccgcagttacggctgattctgcatcaagcagcatctgttttaattcgtcagcgagcttatccggctctggtgtatctcctccgacagaggcaaagccgaatccgtattcagccgtgtaatcaaagctgaaggtttcatcaatgtagcctttatcgtacaagttgccgtaatgcggtgagctttttccgaagagacattcaagcatgaggttcatgctgagctcgtgcttcaacagctcccgccccgttttataagggtctttcgcctttaaaccgacaagacattttgagccttgcacgttcatttttaattcctgctcccggcggaaaaccgcttcctgctcctgaacctctttacgtttgatttcaggctggtctgtaaacggctttttctcctggtttttccgcacctggctgatgatcgcttcaggatctgcggggccgacgataaagagcagcatattgctcggatgataaaacgtttcgtagcactcatacagcagatctttcgtaatatgagagatgctctccaccgttccggcaatgtcaatttttacggggtggtctttatacatattttcgataaggccgaaaaacagccgccaatccggattatcatcatacatattgatttcctggccgatgatgcctttttctttttcaactgatttttccgtgaaatacgggtcctgaacaaaatcaacgagtgtttccaggtttttctctacattagaagtgctggagaacagataagcggttcgtgtaaatgatgtaaaggcatttgccgacgccccctgcttactgaagtcctgaaacacgtcgccgtccgctttttcaaacagtttatgttccagaaaatgcgcgattccgtcaggcacgtgtaccatttcttccttatttaaaggaacgaattgattgtcaatggaaccgtactttgtcgtaaacacggcgtatgttttattaaaaccctgtttcggcagcacatagacatcaaggccgtttgccattttttcatgatacagcgtttcctgaagctgttcgaaatttatcggtttagtcaagatgctccccccgtcccttttaagaaataagtcgtatccagcttaatgttctttccgacattgataatgtcctcttttgtcactttctcgatattgtcgaggaaagtttcgatcggtatttccacttgggctgaagcctgctgatacagaaattccgctaagccgtatgccgtatcaatcgtttctaacacttggtttttaataacggctttcgtttgggcgatatcgtcctctgaaaagtcaccgttttgcatagcctgaaattgttcttcgataatggtgacggcctgcttataatttttcacctcaatgcccgacatgaccatcaaaagccctttgaagctttccacccttgaggctgcataataggcgaggcttgctttttcacggacatttataaacagctttgaatgagagaaacccccgaacagcccgttaaacacctgcaatgccggataatccggatctgtatatgtcgtattggtccggaatccgatattcagcttgccctgcttgacgtcctcttcatcaatgacttccttcggatcgggctgttcattcgtcttgcttctttcaaaaggctgcagctcccgttcttccgttttaaaatacgtatcaacggccgttttcacctgatctgaatcaacatcgccgatgacgtacaggtccagctgatcttcgcgtatggctttttgataggcttcatacaactcttgcggtgtaatgtgttcgacatcatcgaactcgccgttgacgtgaagggcatacggttcgcttttgcacatttcctgaacgagacgcagattagaatatctcatcttatcatcatatacggcttgaatccgctgtttcagcgtccgtttttcctgcgtgacataaaggggcaggaaggcgccgttttccaaagcgggcgaaaagacaagctctgataaaagctgaaggcctttttccaataacggtgtgcggtccttcagatacttttcgttaggaatctcaagtctgaacgtaatgacatgacgttctcccttttttgtcagatcagctgaaacggatgtgccgtacagctcatcaaaataagaacgcagatcagcggttttcgggcggctttctgttccgcgcagaagcacatgcggaaacagcgccctttttgttacgagctctttcgttaaaggagccagcattttaaacgtcagcgaaacggttttaaatttctcagtctttacgatgtgggcggtgatcccgccgtgctttgacttcatttcatttacgtaagtcatgtgaaacctccttcgttcattctttaatagtatgtattatggccaaatttcaggattcgcaaaaaagagtgcgcagatgtaattatatcaactggaggatttataaggaaacaaaaaacctctgcccgaaaacaggcagaggcattgaacgttattttttcaaattgaaaggccaccagttggctcttccgaatattttcaccatgaccggcacaaaaaacggaaggacgacaattgcgtacatgagaaggcctgttaataccacggttgcaatctgtaataaggaaagaacgcctgacggcagcatggccgcaaaggttcccgctaaaataatcgccgcagaaatgatgacggaacccatatttttcatactgctgatcattgcgggttccgttccttcttttttcagctcattaaagcggtccattaaaaagatggaataatccacaccaagagccatcaaaatgacaaagccgaagaacggcacggcccagtttacgcccggatacccgaagaagtgtgtaaagatgtattccgtcacgccgatggatgcgaaatacgtcagtacgagcgacgccactaaataaacaggcataataagagagcgcagcattatgatgagaatcagaaaaattcccgccagcataaacattgccgtccgtttgaagtctgaatccgatacttctttcagatcggcattcatgctggagactcccgaaacgccgaaagaggcattcttcagatccgtgttcggaatggctctttttacgctcgctttgatcgcttgaatatcttgaatggccgtatttgagtaaggattgttatcaagaacgacggtcaattctgtcgtttttctgtcatctgacatgtacgtattaaacacgcttgtgaaatcactgtttgtcaacgcgtctttcggcacaaaccagcctgtcatttctttatctgaggccttgtgaagctcacccaggtaatcattcgcccccatcatgccgcttgatactttcttaagcccttttacactatcgttaaggcctgaagaaagatcgctgagccgggaagaaaaatcaccgagaccgctcttcatttttttctggccctccgcgagctgtcctgccgccgattcaaggcgcggcatttgtcctgcaagagccccctgtccgtctgacacttgctgcagaccgttttcaatactggtcagaccggtgatcattgcgttaatttgagtgtcgatctttttttgagcggctgccagccgggcaaattgtttttccgcttgctgcagatgatccttttgactgtcgacctgtttagaaaacgcttctgcatccgcgtttgccttggaaacggctgactgtacacccgtaaaggccgatttgatttctttgtaagagggatcggttttgactgacggtattgacgcttccaattttgcaaacggcagccgggcaagctgcttgttcaaatcggcaagctgtctgctggtttcatctttcatcggcaggacggtttttaccaattttaaagcgttttgcgtttctgaagcgagaccgctgttttgtttgagctgtgaagtcagcatttgtttttgctcttcaatctgctttctcatctgggcgacgccggctttattctcattcacgcctgcctgcagtttattcaggttttcgcctatatcagaaagcccggatttcagagacaatgttccgttaataagctgattgacgcttttccccgactcttcgatctgcggctgtgaatcagctaacgactttgcggcatgccctaatccgtccgtgattttttcaagtcctgtattgcctttatcaagcccttcttgaagctgctttgcctgatttgtgacaaataattgattcaatccgtttccggcagggcgcgtggcgcttctgaccgtttttacaccctctgttttttcaagttctctgctgattttttcgatatcaatcaggtgtttttcggtatttagaggctcatcatttttgatgacgactgtggccggaagaagctcccccgggccgaatgcgtctgaaatcgtattaaacgcgcggacggattcatatttatccccgatttcgtcaaggctgttgtaagatagcgatcctttgtaaagaaggatcggcgggacggtgaataccgcaacgattgcaagactgatgagcggccttttaaatgaaaaccgccctgccgtttcccatgctttactttgaggatgggaaatatcacccttaacgggccaaaacagtctttttcctaaaacagccataaaaaacggcacgatcgtcatgagcgcaagcagcagcaccgcgacaccgactgcaacggcggctgccgactgatacagcttaaatgtcgcaaacccgatgcaggcaaatccgatcagcaccgcaccgccgctgtacaaaaccgtctttccggccgttttgtaggtgacgacgatcgcctctcttatatcagcgccatgcgacagttcttctttaaatctgctgagaagcagaatgcagtagtctgtgccgattccgaacataatcgcaaccatgaaaatctgcgtaaaagttgagagcggaaaattcagctggtcgactaaaaatgcgacaatcgactggctgactaaataagatatcaatacagataaaagcggcacaaacggagcgaccactgaccggaatacaaggatcagcacgatcaggataaaagcgaccgttatatattcagtctttttcaatccgtcctgtgagctttttaacacatcttcatcgatcagcgactggcctgtaatgccgtatgatacgccgtacggtttcagctctttatcaattttatttttgatttcgaggatatcgtttttggatgtatcaagctgcagctgaacgagcatcgtttgtctgtcttttgacagcagctgttttttgatgtcgtcatttttctccccgaagtatgaagtcaccgttttaatctgaagcgcttttttctgttcagacaaagtgctgacggcttcttccagacgatcttttttgtctgtcattaagcctttttcgtgaaatacgatgacggcagaagaagacggtgcatctgaatcagacatttcatcaagcaattcatgggcataagaagaggaatatccgtccggtacggaaatctgccctttctcccgtgtcaattcagccatatcaggcgctgtaagcataaatatcaccgttgcggcgatccataccgcggcgatgatccagcgggctcggataatgtttttcattatgtctgctgatcctcctctgtcatcatcaatcgatataatttttcatatgtattaacgaacatctccgcctcgtcttcatcaaaatacataatatatgaacggacgagttcctcaatccgccgctccacacggtgaaatacttccgtccccttttccgtgacatttaaaagtatgctccggcggtcgctttggctgcgttctctattgatgtagcctttttcatacaggcggttcgtcatcgatgtaatggcgcttttgttgacgtggcacaccgcggccagttcaattgatttgcaatccggattgagcataatatagcggagtatgtaatattgatccaatgtcagctctttgttcactttttcagcgataatgctgtcaattttttttaagacgtgcaggtatacatcggaataacgctgaatcagctgctttactttttcttcatgcatcttttccccctccttccaatagttaaaatgtttaactattaaaaaggataacgacttgacgatatcatgtcaatcttcaaaataaaataaaaaaagacagtgcagattacaccgtctttaatgattcctttttttcttttgcttgtgatgagatatttaacagcgctaaaaatacagacacaatgccgcaaaaagcggataaaataaaaatcagccagcctgcatttgacatcagggcagcaaagatcggcggtcccgcagctactccgataaaccgcatgctgttataaaatgaggtgatggttcccgattcctcgttgtctacgccttctgtgatgacagcgtctaatgccggtaatgctattccgataccgataccgctgacacacaaaaagataaataataaataaaaactgtgattccaccataggccgataaacgacagtgtcacggcactcattccgaaaacgatgcagaacttcattttgccttggtctttcccgatttttctgcctgatatatatgaactgacggatagaaataaaagcgggattgccaaaagcgctcctttagccacaccgtcaattccgtatttcttctccagtgagtctgataaataaaaaagaaccccgaacagcaaaaacataatcacgcagccgatgataaataccgtaaagagccagcgtccgtcacgcttaaatatgcggccgacattttttacaaattcggaaatagaaggggcttctttttgtttctccggctttgccaccaaaaacaatacgagaaaaaaactgataagcgaaaaaaacggaatgaaccaaaacggcataaaccaaaaccatgcagccaagagcgacccgagaatcgggcttaatactttcccggccgtgtttgacgtctcaatgtcgccgagccccgcggtaatccgctcatcatcccctttgaataaatcaccgataaacggcatcactacaggagccgcccctgccgaaccgattccctgcagcacccgccccgccaagataatgggataaggatgcttgaacgcggtggaagctatcgcggcaagcgctccgcccgcaccggctatgagaagacaaggcagaagaaccttttttcttccgaatttatcggacaaatatccggcaatcggaatacaaataatcgccacaatcgaatagaccgttataattaacgatacttgaaaagacgatatggacagcttcttttcaatcatcggaagcacaggaatcagcatggaattcccgagtgtcatcacgagcggtacagaagccagagcaatgatattttttgttccatttttcttcttactcaacttattcacccattcactatacttggttgtttcctgttttattgtgccttgcggaaaacaaagtatgtattgaagcggcaaataaaaaaacagacacatgacgcgtctgtcttaaaaacgttttcttacaacatgaaaactgaacttatcagcccggaaataatttaatgaatacagcacaggttcatcattctgattatagtgggtttgcttcagcaataaaagcgccgtctccggctcgcactccaaaaccggtgaaatcgtatcgtgatatccgatcggttcgatatcggcaacggcatagctgatcacagacccggagtttttttccaaaagatcaaaaatagattcctgttcatgacagaaagaattcggcagaatgtgcatcggaatcgtatctaaacagtaaacgaccggagtgccgcttgccgttctcacgcgttccaaataaaaaagctcctgctcaggctcaagccggaatctagcgatatcttcctcagacggcgtgatgacctgagacgacaaaaaaatcgtacccggcaccatgttcgcctgctgaatcattttcgtcacgctgttgagctgttcaatacctgaaagaaacagcggttttgtatggacgaaagtgcccacaccgtgccttctgataatcacatgctcctcttcaaggatacgcaaagcttcacgcagagttgcccggctgacacccatagattttgaaagctcaaattcagaaggaagcttttccttttcggtgtaaattccgttttgtatatcctctttgattcgctcaatcacttttaggtacaagtgacgattgtcagcttttgtagacatgtttcccctccgtaaaccactttcataaattattgaacaattgggacaactatatcatgttttaataaaaaaataaataggaatgattttggtgatatcattttcagtgaaaactctctcctttttaagaagagagctcatcatattgttccttagataatagtacttccctcggtttgcttccttcatacggcccgacgacgccccgttcctccattgcgtcaatcagacgggcagctctcgtatatccgattctgaaccgcctttgaagcatggagactgatgccgtctgcatgccgataatcaaatcgaccgcttcgtcatagagatcatccgttacttcactgtgtgtttccgacacttcttccggaatcatctcttcttgatactgcgctttttgctgcgtaatcacatgatcgacgacatgctcaacctcttcatccgataaaaatgctccctggacccggacaggcttattcgcgcctacaggcagaaacagcatgtctccgcgccccagaagcttttcagcgccgcccatgtctaaaatggtccgtgaatcggtctgagatgagacgctgaaggcaattcttgacggaatgttggctttaataacaccggtaatgacatcgactgaaggccgctgtgtcgcgataatcaaatgaattcccgccgcccgcgccatctgtgaaagtctcgtaattgaatcttccacgtcggaagaagcgaccatcatcagatcggcaagctcgtcaacaatgacgacgatgtacggcagctcaggctgcttgacttcttcttcggcatttgaccgcttaatatggtcgttatagccttctatatttctcgtacccgtatgggagaacagctcatagcggcgctccatctcattgacgacctttttcaaagcctgcgaggcctttttcggatctgtcacgaccggcgcaagcagatgaggaatgccgttatacacattcagctcaaccattttcgggtcaatcatcatcatcttcacttcatgcggtttggccctcatcagaatgctcgtaataataccgttgacacagacgctttttccgcttcccgttgcccccgctacgagcaggtggggcattttgttcagttcggcaagcacggcttccccggaaatatttcgtcccaagccgatcagaagcttcgcgtccggcttgtcattgagcttggattcaagcacttcttttaacgaaaccatcgcaacttcagcattgggcacctcgatgccgattgctgatttgcccggaatcggcgcttctatccggatatccttggcggcaagcgcgagcgcgaggtcatcgctcagattcacgattttactgactttgaccccgacgtccggatacacctcatattttgtgaccgccgggccgagatgaacttgggtcactttcgcctttaccccgaagctttgaaaggtccgttcgagttttcttgcattctcgtaaatgtttttcttatcggtctgctggccggtatgtttcgggtcagccaggatgtccaatgaaggcatttgataatctttattttcaagctctgtaaacgtcatcggcggagccgcagccgtttcgtcactgtcttgagcgccgccggaaggctcatcttttgccgtttgcgccgtctcctgcgttttttccggaatcagcggttcgacgcgttcttcctgacggtctgaaaagcttgaaataatcggctctgaatggatgatcggcgaaatgatttcctcatcctcttcttcgggctcaggcatttcttttttcttctgaacccgtttttgttttttgcccgatttggtttttgttttcggcgaagacatattcgttctgaccgttttcatatcctcaagaaatgcctgccattgaccgcggataaaccggccgacggggctcgtccactttttgagcgtttcctgcagtgaacgccccgttacaagaatcagccccattaagatcagcacgatcgccatgatctgtgaacccgttgatgcaaataaaaagtgggaagctgcaaacagcaccgcgccgatcatgccgccgcccaaatcaggggaagcagcctgctgtttcatgtcaatcataaacagctcccacgtgttgccgatgacacttgccgaccgaatcgacccgtgatgagacagatttttaaagagctgcacgtgagacagcagcaaaatactggcgataatacagtacaaccctgcctttctcctcgttaaaaggcttggactcttctttttccaaaacagcgaaattccgagaaggaagagcgcaattaagcataaaataaaccactctccggcaaaaaaacggaacaagtacacaaatgtctgtcccacaacgccgagctgcaaaacagcaataatcgagattgcaacacagagcagtccgcttagttcgtattttagattgagcttactctcttgtttctttttagatttccgttttttctttgccacactcatcaccttactgcgttaaaaaatgtaaaatcatacatcatgaagaaaagcagccttttgccggctgcatttttctgtaggattcccctattatagcatattttgcccccgagaaacggactgaatgccggttagattttcagcttgattttttgtcccggagcgatgtccggattcagaaaatccatcgggttcgtacttaaaatctgtacgacttcagcttcatttcccttcatctcaaccagcagcggcacgccggcgtaatctacctgttcatgcacgctttgctctatatcctgaccgtaaacgacttcttgtggcatgacggtataaaggatcattgaatcatccttccttcctcgccctttcgttcctcaatcagctgattcagcttttttatcgcctgtccgacgccgcccacggcatcaattaatccgtaatcagccgcatctttgccgactacgttcgttccgatgtccctggttaagtttccttttgaaaacatcagctctttgaatttttcttcggaaatatttgaatgatgggtcacaaagttgacgacccgctcctgcattttatccaggtattcaaacgtttgcggaacgccgataaccagacctgtaagccgaacggggtgaatggtcattgtcgctgtctccgcgataaaactatgatcacatgacacggcgatcggcacacctatggagtggcccccgccgagtacgattgagacggtcggttttgataaggatgcgagcatttccgcaatcgcaagccccgcttccacatcgcctccgacggtgtttaagatgatcagaagtccttcgattttcggattttgctcaatggcgacgatttgcggaatgacatgttcatatttggttgttttattttgcggcgggagctggacgtgcccctcaatttggccgatgatcgtcaggcagtgaatattggtatcttgggacatttgcggcagagatgtctctcccagctgctgaattttgctcataatgctgtctttcgcatctgatttttcgggctgctgttcttcggtgttttccatacgatgatccattttatctttcaccctttccgaatgtctctttgtattatgaacaaagatgatgatttccatccgggacatgaacaaaaacaaagccggagcatcatgcgctccggctttgtatacattatacttccataatgatcggaatgatcatcggcttgcgttttgttttttcataaaggaattgattcagcgcatcacgcattgcttgtttcagcgtggaccattctacggcagatgtttccgtcgcttcagtcacgatagagcggacgagctcagtagcttgtacaattaacccctctgattctctgacatacacgaaaccgcgcgtaatgatctcagggcctgaaacaaggttcttcttctgcttatcgagtgaaatcacgacgatgagaatgccgtcttgtgacaataagcggcggtctctcagcacgatgttgccgatgtcgccgactccgaggccgtcaatcagaacgtttccgtatgtgactttatccccgattttcacattctggccgcggaattcaacgacatcacctttttcaatcaagaaaatgtcgctgcgtttcatgccgatctcttctgcgattttggaatgcgctttttgcattctgaattcaccgttaaccggaattaaatatttcggtttcagcaaattaagcatgagtttcaattcttcctgcgaaccgtgaccggacacatgcactcgtttttgggcgaaaatgacttgagcgccggcgcgggcaagcaggttgacggttttggaatatatcaattcatgccccggaatcggtgttgatgcaatgacaacggtgtctccttcttcaatgttaagctgcttgtgcgcctgcttggccattcgcgtaagagcggccagcggctcaccatggcttccggctgtaacaattgccacgtcccgcttcggatattttttcacatcctgcacaggaataaacatttcatcttcggcttcaatatagccgagcttgcgtccaagctgaagcacgttttgcagattttttccggcgattgcaagtttgcggccgttctggacggcagcctgtatcacttgctgaatccggttgatattagacgcgaatacagcaatgatgacacggttttctgaattgttcatcgcatcggaaatttcaccgcttacatatgcttctgacggagtataccccgggcgctccgcattggcgctgtcagaaagcagggcgagcacgccgctgtttccgattttggcaatttcgccaatatcacatgattgatgataagcaggcgtctggtcaaatttgaagtctcccgtgcatacaatagagccaagtgatgttttgaagctgactcccactgaatccggaatactgtgaatcgttttaaagaacgatactttcgttgattcaaatgtaatgactgatttagagtgaacttcacgtaaatcagcttttcgattatgcccgtactgcttgagtttttctctcagtaatgcaagcgtaagcttcgttccgtataccggcaccgacagcttgttcaataaataaaagacgcccccgatgttttcatcgtgcccgtgtgtcagaaagatggccttcacgcggtcagcccgttctactaagtaggaaatatccggaatgacgacatcaataccgagcatttcattttcagggtgcatcagccccgcatccactacaaatatgtctgagtcaatttcaatgacatataggttcttcccaatttctccgacgccgccaagggcgataattctgacgttttctgtatttttctttttcaaaatctgtatcctcctagtctcatacccgtccatcatcacttgttcctattataactgatatcaattttagaaaacaagaagaagcggaaggtttagggaaaaccaatatgtatacaaaacggtcaaactcacgataaaaatgagaatgaccgcgtatttcaactgtataaattttttcttacagttcgctgatgacgctgctcaggctcagacgttcatcttcattcagcgggataagaggaagacgcacagatccgacatcaaggcctttcagctgcagcgccgttttgaccggagccggattaggcgctttaaagagctccttcatgatcggcagaagcttctgatgaatcagtgccgcggttgccgtctgcccgttcgtatagtttttaatcatctgctgcatgtcagaacccacaatatggctggccactgacacgactcctcttccgccgactgcaagaataggaagcgttaacccgtcatcacctgaatagacgtaaaaatcttccggcgtttcggcaatgattttcgtaatggcatcaagatcgccgctcgcttctttaatcgcagagatattcggaatctccgcaagtctgatggccgtttccggcgcaagcgaagcgaccgttctgcccggcacgttgtaaagcatcacaggaagagacgtttcttcagctatggctttaaaatgacggtacatcccctcttgggaaggcttattataatacggcgtgacaagcataacgcaatcgacgccggcttcttcagctttttttgtcagtttaatggaatctttcgtattgttgcttcccgtacccgcaataacaggcacgcgtccgttcacttctttgactgtaaattcaaagagtgcaattttttcttccgttgaaagtgtcggggattcgccggtcgtgcctgcgacgactaaagaatccgtgccgtttttcaacaaatagtcgattaatgtagacagtttttgaaagtctacattccctttactgtcaaagggggtaatcatcgctgtagatatatttccgacattcatttttttcacctcatcatgattcaatcacatttactttgaaagttcaaacacttcatgcagcgcatttacggccgttaccatatctttttcatgaacgagcacccagatcgtcgtatggctgtcggcagattgcagaatcggaatgcctttatcagaaagtgcggagacgatttttgacgtgacacccggaacacccattattccggcgccgaccgctgacactttcgcacagctttccgtcactgtcggctcatatcctaattcagccaaaatgctgcgcgcggcttccgttttactgccggctacggtatatacgatttcactcggcgtaatgttaaagaaatctacactgattccggcatttgccattgctttaaagacttcagtctgaacgttgtattgccccattttggcgggaaccttaaattgcgtcacgtctttcacatgggcgatccccgtaatcagccgttcgaatacatcgctgccgatgttagacgaatgatgggacgtcaccaaagtgcctttgtcttttgaataagtggagcgcacgcggatcggcacctttgcctgcatggcgatttccaccgcgcgcggatgaatgactttcgcgccttgataagcaaggttgcagatttccgtatatgtgacattcggaagcggcttagcattttccacgattctcggatcggctgtcataacaccttccacgtccgtaaaaatgtcgataaactcagcatcaaccgccgcgccgagcgccgccgctgatgtatcgcttccacctctgccgatcgtcgtcgtgtcgcctttttcagtcgctccctgaaagcctgcgacaacgacggcatcatggctggcgagtgcagcgaaaagccgctctgttttcatttctataattttggcgtcagtatgctgggcattggttaaaaagccggcctgagctcctgttaaagctgcggcttttatgccgttttccttcagcatgctggaaaaaacaacggacgaaatcgtttctccgcaagacagaagcatatcctgctctctcggagaaatgtcggactggctgccgtaaaggagcccgattaaagaatctgtcgcgtacgggtctccttttcttcccatcgccgatacaacaacgacaaccttataaccttcacttatggcatcttttatgtgtgctagcgcaagcttgcggcctttgtcatcttttacggatgttccgccgaatttttgaacaatgatcttcactattttcactccaaattagtctgacgtaacagaagagagcaggcagagccttactctcttctgttcgcctatagaaaatacgtttgttttatacgaggttcagtttttgcaggctttccgcgatttgaactgagttccaagcggcgccttttaacaggttatcagaaacaacccacaaatgaaaaccgtttgctctgtccaaatctttccgaattcttcctacaaatacatcgcgtttgccgacgcaatcagcaggcatcgggtaaagctgctccgccggatcatcctgaagcgtaacacccggagcttcttttaaaagctgtttaatatcttcaacggttgcgtcatcacggtcaagctcaatgtaaacagattctgaatgccctgtttcaatcggcagtcttacacatgtcgcagccacttccagcttcggcatatgcatgatttttttcgtttcattaatcattttcatttcctcaaacgtatagccgttgtcttggaatttatcaatttgcggaatggcgttaaatgcgatttgataatgctttttgtcgcctttaaccggcataatggacggttctgcgggttcattgtttaaaatcgcctttgtctggctgtacaattctttcgccgcttcattgccggctccggacacagcttggtaagtagatacaatgacttttttcaaaccgtacgctttgcggatcggttcaagcgcagccaccatctgaatcgttgaacagttagggttggcgataatgccgttatgtttgtgcagatcaccttcgttcacctcaggcaccacgagcggtgtattttcgtccatacggaatgcgctcgtattgtcaatcacgatggctccccgttttacagcctcaggcgccaagctttgtgatacgcttccgccggcgctgaataacgcgatatgaacgccttcgaagctttcaggaacagcttcctgcactgtatattcttcgcctttaaacgttactttcgtaccagcagaacgctttgaggatagtagtgtgagtgtttcgatttcaaagtttctgtcttccagtgttttcagcatttgctgtcctacggctcccgtcgctccgacaactgctacgtgtaatcctcttcccatctgtaaaactccttccgccaattaagcatcatttgttgaattgactttgcattttacgttttattttaccatagaatagtcacggattgaccgaatttttttattccggaatgattttctgtcatcatgattttttattcatgatggtgtacgagcaccggctgaacctgctggtgcaaaagagctttttctaccgtaatcggaaggagatccattctggcgacgagcgatgtcggttttttcacgtggtcatcctggccgaacgggatgaaatatatgttttttgcggacatcagcctcattaaattcgttccgtttaaaccgagtccgtcatttgtcgaaattccgagcacgaccgggcggccgttgcggatcgtggctttcgcagccataaggacggggctgtcggtcatcgcatttgcgagtttgctcattgaatttccggttaaaggggcgatgaccatgcagtcgagcggaagtttcggcccgagtggctccgcttttacgatggaatcaatcgcctcaaagcctgttgtttcttcaatttttctgacccaatctcccccctccccaaagcgggtatcggtcgattgaacggttgatgtcacgaccggccggacttcagctccttgactgataagcgcctctatttgcggaaacacttcctcatatgtgcaatgcgagccggttaatccgaatccgattcttttccctttcagagacatggttatttcccctctttctttaagtctgccaaaagcttgctcaatacgttcgcaataatctgtccggctgttttcggggccacaattcccggaagacccggagcaagcagcgctttaatgccttgtttttcagcatatttgaaatccgttccgcccggacgggatgctaaatccaaaatcaaggtcttgggcgtcatgcgcgataaaacgctttgattcagaatcaagctcggtacggtgttaatgcagatatcaatatcatttacatgatcagtaagctcttcaagttgaaaaggagaaagccccatttccgatatacgggctaaatgagccgaactccgcgcgcccacttttactttcgcccctaacgctgcaaacgtccgggcgatcgtcataccggtgcgccccatgccaagaacggcgacatttgatccgtgaatggtataatccgtatgctgaatcgccatcatgattgttccttcaacagtgggaatcgagttgaatatcgcgatgtcgtcccgctcaaataatttcacaagcttacggccggcttcgctggcgatcccctcaagatacgcgttggagatgcctgaataaatgacgcaatgctccggtgtccgctcaagatagctctgctttaataccacttcttcatttgaaaaaaccgtggaaacaacgccttctccggtcgttgccgatacaggcaggatgatactgtctattttttgaaagggaatctcatcaattttgcatttgacggttcctgtaaaaccgtcatccaattggtcaaaccctgcaagataaatatcggcatgctgttctgtcagctttcttataatctcaagctgtcttgcgtcaccgccaatgatcgcaattgttaatccggttaacatctgaaacgttcaccttctttacagttactggatcctttaagtgtcatcctcctcttcatcgtatgtgcaaagagaaagggcggtgaatgtacagcgtctttttcataaaaaaagcaccggctgtatgagccggtgcttgcaaaaaatgaataagatctactcttcgggaggcgtgatctcccccggaacgtctaaaatgatcatgtctgacccgattttttggatatggttccaggggacgcggatgtcgtggccttgttttcgcagtccgaaccattttaccgtcggtatcaacagcgcggtaatttgtccgtcctgttcattaatttccaaatcggtctggccgagcacgccgagccgctctgcccgtttaatatccacaatttctttacctgacagttcactgagcctcatgatagccacccccttgtactatatgacccggagcaaaaaaaaatgcctgccccgtacagaggcagactgctttgcagcttaagacgaggccggtatattgccggtcgggctgatgagcgatagtgcgtaatcatccgtaaataagcggcggctgaggccgttgacgctttccaggctgaccgcatttaattcagcgataatttcatccatggtcttatgctttccgagcaggagttcatttttcccgttccggctcattttgctgtttgtgctttctaagctgagcattaagctccccttcatttgctctttgctgttttccagctctttcggggtgataccgtcacgttttagaaccgataacgtttcctgaatggtttcagacagaagtccgagctgattcgcgccggtgcctccgtaaatcgtcagcataccgctgtcttcataggaactgtgatagctgtatacagaataggccagtcctttatcttcgcgcacatcctggaaaagacggctgctcatgcttccgccaagcacgttgtttaagacgatcaaatcgtaaatgtccggatctccgactttcaggcctttgaaaccgagacagagatgcgcctgttcggtgtctttttttctcgtcagcttttcataatgaaactcaggctcgctgatgccgcttgctttgcccttcgcttcgtatgtaccgaaccatttctccacgtctttaatgaattgttccgttacatttccggcgacagaaatgacgacgcggtccggcgtgtaaaagtcatccatatgctgtctgagagaatcgccgttaaacgacgaaagcgtttcctccgtcccgagaatcgggtatccgagcgaatgattgccgtatgtcgctttgctcagcagatcgtggacaatgtcatccggtgcgtcttcatacattttgatttcttcatatacgacgttcttttcttttttgagctcatcttcgtcaaaagcagaatgaaagaacatatcagccagcacatcaagtgcgtagtttgcatgctcatccagcactttggcgtaatagcacgtatattcttttgaagtgaaggcattcacttggccgcctatccgatcgaaggattctgcgatttcacgtgcggacctggtatttgttcctttaaaaaacatatgctcaagaaagtgcgaaataccgtttgtctccggcgtttcatgacgtgatcccgtcccgatccatacgccgattgccacagaccgcaccgttggattattttcaagcacaactcttacaccgttttggcatgtatagcgttttatcaagtctgttcctcctattcaaagacaggcagctgcctgctacttcatcagcctgttttcatccattaagtcagacactgagccgagcgcgtagcctttttctttgatttttgcaatcagtgtatccaggcttttcgcagtcggatcagtcggatgcattaaaatcatggctccgttatgtattttgctcagcacccttgtttgtaaaacagcgggagacggtttttgccagtcaatggtgtcaacggtccacatgatggtgcccattcctttttccgccgcaaggtcgaccacggcttttctgaagctgccgcttggcggcgcaaaccatttcggcttcatgccgagcgtctcgctgatttgtgcattggttttgtcgagctgttcggaaatgcttcctgaagtcagtttgctcatatcagggtgattgtatgaatgatttccgatttcatgtccgtctgccgctatttttttccccagttcctgattgtttttcagccatttcccttcaagaaagaaagttgctttgacctggtgctgcttcagaataggcagcatttgctccacgtattcatttccccaggcgacatttatcaggaaagcgaccatcggtttgtcgggatttcctttataaatgggttcgggcgcgagagaatcaagatggactttcggctttacctgctcatagacaaggtcgtcttcgtgaaattctccgtcctttttcatttgtttataggatttttccacattgacttttaaaccgttatatcccggtatactcttccatattttatcaatccgagcgtcttgcggcttcacttcatactctgacgctttttgcagtaattcttcatagagcggatcttttgatgatgacacagttaccgcgtcttttttcattgcgtctatgtaatcaactgtatacgggttttttaacatttcaaacgaaacaaaaaaaagaaataaaaaaacggcaaacggcacgaattttttcaacatgtccttccccctcatcacacattatgtatgaggaggacaaggtagaacccgtctgttgtctttctcaaaataaagaagccgggtctcccaggctccttgttaggttttcatttaagattgttgttgttcctgttctttttctttctcttcgcgcagcactgctttacgcgacagattcactcgtccctgtttgtcaatttcagttaccttcacaaggatttcgtcaccgattttcacaacatcctcaaccttgccgacccgttcgagcgctagttcagagatgtgaacgagaccgtcttttccgctgaagatttcaacgaaagcgccaaatttctcaatccgtttcactttaccgaggtaaagctggccgacttcgacttctctgacaagatcttcgatgatttttttcgctttttggttgctgctttcatcagtagaagaaataaagatggtgccgtcttgttcaatgtcaattttaacaccggtatcttcaatgattttgttgatttgtttaccgctcggtccgataacgtcacggattttatccggattaatggtcatcgttaaaattttcggcgcatattgagaaagttcttttcttgattcaccaagcgtgctgagcatgctgtccaagatttccattcttccttttttcgcctgctgaagcgcttcttcaagaatttctcttgaaaggccttcaattttaatgtccatttgcagcgctgtcacgcctttttccgtgccggctactttaaagtccatgtcaccgagggcgtcttccatcccttgaatatccgtcaatactgtatagtactcgcctgatttcacaagtcccatcgcgatacctgcaacaggggctttaatcggaacacctgcgtccatcatggcaagcgtacttgcgcagatgctggcctgtgaagtggaaccgtttgattcaagcacttcagatacgaggcggaccgtatacgggaagtctttttcattcggaatgaccggctcaagcgcacgctctccaagagcaccgtgaccgatctcacggcgtcccggtccgcgcatcgggcctgtctcccctacgctgaactgcgggaagttataatgatgcataaagcgttttgactcttccacgcctaaaccgtcaagaatctgaacgtctccaagggcgcctaatgtacaaacgctgagcgcctgcgtctgtcctctcgtaaacagcccggatccgtgcgttctcggcagaagaccgacttctgaagaaagcgggcggatttgatcaacgccgcggccgtccggacggactttttcttctgtgatcaaacggcgcacttcgtttttcacgagtttagacagtgtctgtttcacttttttaattgtatcttcatcatgctcttcttcttcgaatttcgcgacaactgcatttttcacttcattgatcgcgtcttcgcgagcatgtttttcgtgaacctgaatggcgctgagaagatccggctccgcaaggctttttacttttgcgctgagctcttcgtcaatttcatacagttcgatctctgttttctctttgccgactgctgcgacgatttcttcttggaatgcgatcaggcgcttgatttcttcgtgaccgaacataatcgcctcaagcatgatttcttcaggaacttcatccgctccggcttccaccatgttgatggcatcttttgtgcctgcaacgatgaggttgatatcacttttttcaagctggtcaaccgtcggattgatgacgaatttcccgtcaatgcggcctaccgtcacacccgcgatcgggccttcaaacgggatatcggaaacgcaaagagcgagtgatgaaccgaacattgcagccatttcagatgagcagtcctgatcaacactcatgacaatgctgatgacctgtacttcgttacggaatccgtctgcgaaaagcgggcggatcggacggtcgatcagacggctggctaaaacggccttttcacttggacggccttctcttttaataaaaccgcccggaattttacctactgcgtataatctttcttcatagttaacggtaagcgggaaaaaatctagcggtttcggttcttttgatgcggttgctgtgctgagcactgcagtatcgccgtagcggaccatgacagcgccgtttgcctgtttggcaagctggccggcttctactgtaagctgtctgccggcccaatctatggtaaagacatgtttctcttgtcccattcgattacgagctcctctcttaatgtgtgaaataatcaattactcctattatgaacgaaatgaattgaacatatcaatgtcaaagtagtatgtaaaaggatttcattgtttttttattattatttttttcgctttaatacgataaaaaagcgggaatcctcccgctttttacgattatcgacgtaagcctagtttgttaattaactcacggtaacgagttacgtctttattacgcagatacgtaagaagattacgacgtttacctaccattttaagaagaccgcgacgtgagtggtgatctttcttgtgagtacgcaaatgctcgttcaagttgttaattgagtctgttaggatagcgatctgaacttctggagaaccagtatcagattcgtgtgttttgaactcgctgatgagttgatttttacgctcttgagtaattgccatcctgtttcacctccatatcataattagccccagttacctagcaaccgtcggtgacttcggattgccaagcaatggttttaagactacgaaacatatgatactaaaaatcgcgcccatatgcaaatcttttagaataaaatttgtgtacttttgatgttttttccgttatttgctgaaaaaacggatcgcttcttgtttgtctttcccgatctgagccgtcagttcatcgatgccgttaaacttccgttcgcttcggattcgtttgtaccactcgattttaacgtcttctccgtatacatcctgttgaaaattaaacaaatgaacttcaattgacggctgatcgggacgcttttcataaaaggtcggtttgtagccgatgttgcagacgccttcatacacctcgccttttatttcggctttcactgcatacacgcctgtcggcggcacgatatagctgttgtgcaggccgacattcgcggtcggaaaaccgatggtgcggcctctcttgtctccgtgaatcacagtgccccggagaaaatacggctggccgagaagagtgtgcgcaagttcaacgtcaccatcctggagcgctgaccggatataagtggagctgatctttctgtcctgctcggtctgtttctcgacagtcgtgcatccggccttgccgtttaaatcgtccggcagcgtctccatcgtgccttttccgtattttccgtacgtaaaatcgaagcctcccacagcgtgccgcgcgttcaaccctaaaatatactcctcggcaaactgttttggagacagagacgcaaacgcttcatcaaactttacgacatacagcacatcagcgcctaaacgtccgatctggctgattttatcttcaagcggcgtaatcagatcctttggctctttgtccctgcccaacacatgggaagggtggggatgaaacgtcataacggccagcgacaggcctttttcttcggcaatttgtctggctgttccgattactttccggtgtcccaaatgaacgccgtcaaagtagccgagcgccatgacagacgccggctgctcttctttttgtaaatgatgcggatgagaaatatgtatcgtcttcacagaacggtcaccttttttcttattgttcgcttttttgcatgagcactttagccggtttcagcagtcctttttttgaaggatgcggcatataaatggccacacattctccgtcttcagtacagaccgctatacgggcgtcagctgtcattgcagaaaattccgccgggatgtcaaacactgacccgttttcagctttcttagctaatgtatcacttatgacccatttcggcaaatgattgagcgctctatcgatcggcacggcatgctctgcaaccgttccgtccgaaacctgctgttcaagttcctcaaacgtgaaacactcatcaaggctgaaatcgccggaagcagtgcggatgagatgcgacatatgcgcgggatagccgagtttttcaccgattgtcaccgccaacgttctgacgtaagtgccttttgagcacgtgactgtaaagcggaatgatgctgtgtcttcgttataagtgacaggggaagtgagcgcgatatcttcaatcgtgatattccgcttcggccgctccacttcaatacccgctctggcgtattcatagagctttttcccgttgacctttaccgcggaatacatcggcggcacttgctcctgcggtcccttcaattcgtctaaaacggctttgatatccgcttcttccagcggctccctgacaggctttacgctgaccgtttctcccgtctgatcttcggtcgatgtggagaaaccgagagtgatctcagcatcgtacgtttttgacttgtcggtgacgtactcaacgatctttgtagcccgtccgacacagatcggcagtacgcctgacacttccggatcaagggttcccgtatgcccgactttctttgtttttaacagttttcttattttcattacacagtcgtgagaagtcatgccgaccggtttatgtaaaaggagaactccgttaaccatctgtctttcgctcctttgttatcaattgtatcccgtaaaacgcagaaaagaggacagacgacactcgcccatcctctttcccgttattcagacggtttatctgaatgcagttcgtgaatcaatgtttcaatacgattgccgtactcaattgattcatcaaattcaaattcaagctcaggcgttttgcggagtctgattcggctgccgatttcggaacggataaatcctttcgctttctcaagccctttcagcgcctcttctttctttttctctccgccgagaacggagatatacaccttcgctatttgcaaatcacctgaaacacgtacgtctgttacagtgagaaatccgattctcgggtctttcagctttcggctgataatatccccgagctcttttttcatctgctcgccgacacggtttgctctcatactcaattcaatcacctctaagttaaaaccactctgttctagtgatcgtccgttctatctcgggaaaggagtcaataaacgcgagtacgcgctggatctccttttccgcctgaacgtgagaggaagagacgacagcgattccgaagctggtccgctgccaagtgtcctgatagccgatttctgcggccgacacgttgaacttattctgaaccctcgttataatccgcttcagaacggctcgtttctcctttaatgatcccgcatcataaatgatgcattcacattccgcaaatccgatcactttctttcgatttcctgcatgacatacgcttcaaggacgtcgccttcgcgaatgtcattgtatttcttaatcgttataccacattcatatccttgtgaaacttctttcacatcatctttgaagcgtttcagaacgtctacttccccttcgaagatgaccacgccgtcacggatcaggcggagtccgctgtcacgtgtaatgtggccgtctgttacatatccgccggcaatcgtgccgattttcgacactttgaatgtttggcgcacttcaacctgaccgatgactttttcttcgtattcaggatcaagcattcctttcatcgccgcttcaatttcttcgatgactttgtaaatgatacggtgaagacggatatctacattttcagcttcagccgtgctcttagcatttccgtctgggcgcacattaaacccgataacgattgcatttgaagctgatgcgagaatgatgtctgattccgtaatcgcaccgacgcctgtgtgaatgattttcacttttacgccttctacttcaattttttgaagagcggctgttaacgcttcggctgaaccttgaacgtcagcttttacgattaaattgatgtctttaacatcgccttgtttaatttgttcaaacagatcatcgaggctcagcttcgctttgtcgctgcgctgttcttccagttgcttggaagcgcgtgcttcaccgacagaacgggctgttttttcatctttaaagacgaggaattgatcgccagcctgcggtacgtcgtttaagcccgtgatttctacaggtgtggacggtccggctgttttcacgcggcggccgagatcattgaccatggcccgcacgcggccgaatgtatttccgacaacgatcggatctccgacatgcaatgttcccgtttgaacgagaagtgttgcgacagatcctcttcctttatcgagctcagcttcaataaccgttccttttgcctgacggttcggattggctttcagctcttccacttcactgacaagcagaatcatttcgacaagctcgtcaattcccttgcctgtaagagcagacagaggaacgaaaatcgtttctcctccccatgcttcaggaacgagtccgtattcagtcagctcctgcatgacacggtcagggttcgcgctttctttatccactttattcacggcaacgataatcggaacctcagccgctttcgcatggttgatggcttcgactgtttgcggcataacgccgtcatcagccgctacgactaaaatggtaatatcagttacttccgcaccgcgcgcacgcattgttgtgaacgccgcgtgtcccggagtatctaagaacgtgatttttttgccgttttcttcgatctggtacgccccgatatgctgggtgattccgccggcttcaccttcaacaacctttgtttttctgatgctgtcaaggagggtcgttttcccgtggtcaacgtggcccatgatcgtcacgacaggcggacggatttgaagatcttcttctttgtcagcctcttcatatttttcaagctcagtttcttcaagcacaatcacttcttctgtttccacaccgtattcagatgcgatcagttcgattgtgtctttgtcaagctcctggttaatggtagccattacacccagaagcatcagttttttaatgagttcagacggttctttgccaagttcttcggctaaggccccgactgttaaagagccggaaaacgtaattttctcaggaagctcttttttcggcttcagcggtttttgctgatactgatttttgttgttatgattgcgtttgtttttgtttttgttgttgttgttattcttcttgtttttgttaaattgattattctgcacgtcattcttctttccgtctcgaattttgtttggttgattcccagcaggctgctgattaatcccttgcggcttgtttttgttcgtttccgcaggcttctgagatgtaacgccggcgccgccttttttaaatttcgcatcaagctgcttaatggtcttttcttcaagcattgccatatggttatttactactatatccatgtttttcagcgcagtcaaaatttccttgcttgaaacattgatggcttttgcatattcgtaaactctcattttagccattcgttcacccccaaaaatattaatcgagcaagctgatcagcttattcgcaaaaccttggtcagtgacggcgacaacgacacgtgattccttgccgatagagcggccgagatccgcgcggctttcgacttttttataaggcactttataataattgcatttatcggatactttttttgcagtattcgcagatgcatcttctgtcagcagaacaagttttgcacgcgcatttctaatttcttttataaccaagtcctcgcccgacacgaccttacgagctcgattggccagacccagcaagggaaaccattccattccagacatgttattttttcaccttttccgccagttccagcaattcttcgaaaatctggtcatcgatttgtgattgaaattgattttgcaatgtgtttttctttttcgcagctaagatgcattctttctcaagggtgatataggcaccccgcccgttcttctttccggtcggatcgactgaaatctctccttctttagaacggacaattcggatcagttcctttttaggcttcatttcccccgttaccacgcatttgcgcagaggaattttttttcgcttattcacctaaagtcacctcttattcatccgattcggctgtttcaggctccataaagagcggctctaaatcgtcatcttcttcatgctctctcggatagatgccaaggtctcttgcatccgtttcacttttgatatcgattttccagcctgtcagtttcgcggctaagcgggcgttttgccctctttttccgattgccagagaaagctggtaatcaggaacgatgacagtcgtggctttttcttcttcgctgacgatgacatccagtactttagacgggctgagcgcattggcaacaaattcaaccggatcatcagaccagttgacgatatcaattttttcgcctttcagttcattgacgatcgcctgcacccgctggcctttaggaccgacgcatgaaccgaccggatcaacgtcagggtcatcagtgcggacggagattttagagcggtcgcccgcttctctggcaacggatttcagttcgaccgttccgtcataaatttccggcacttcgatttcaaaaagacgcttcaacagaccaggatgcgttcttgatacatagatctgcggcccttttgtcgttttttcgacttttgtgataaatactttaatccgatcgtgcggtttatagctctcattcggcatttgttcattgacgggcagcagcgcttcaatcttgccgagagacacgtaaataaacttgctgtctaagcgctgtacaattcccgtcatgatgtcttcttcacgatcgataaattctgagtaaatcacgccgcgctcagcttcacggacacgctgcgtcaccacttgtttcgccgtctgcgcagcaatgcggccgaagtctttcggcgttacttctatttcaacgacatctccgacaaggtagttcggatggatgtgctgggcgtcgtcaagcgagatttcaagtcttgaatcgtatacctcgtctacgacatcctttcttgcgaacacgcgaatcgtgcccgtctcacggttcagatcgacccgtacgttttgcgcctggttaaaatttcgcttatacgcggaaattaaggcagcttcaattgcttcgatgataatgtctttactgatgcctttttctttttcaagaatagtgagagcatctaatagttcactgctcatgttagcggtctccccccttaaacactaatacttcattcattaaaatgttacagctaatcttgcgttagctattttttcatacggaatattgacccgtttctttcttgttttgaccgtcatctctattgtaacagtttgtccatcaaattcagccaatttgccttcaaacacttttaaaccgtcaatcggttcgtacgttttcatgtacacatttttgcccagtgatttttcgaagtcggcttttttctttaatggacgctcggctccaggagaagatacttcaagaaagtagttctgagtgatcggatcggcctcatccagcttttcgcttaacgcttcgctgactttggcgcactcctcaatatcaacaccgttatcggaatcaataaacacgcgaaggaaccagttttgaccctctttgacaaattcaatgtctacgagttcaagctgaaggtcatccagtatgggctgagccattccttgaacggtatcagtcacttttttgctcatgtttttcctccttgtgctgtcgatatcatatcagccgttcctctgcataaaaaccctgcttcaaaagagcaggggcattgagaaaacgatggacatgtcgaggcaaaattgcctgttcaatacaaaagagcgggtttccccactctttgcctcggtaatcgttagcatttccaataaaactataccataaccatatatttaatgcaaatcaaactccgctcggaggctgtgcacaaagcttaaaacagagacagctgattttggtccggaagcgactcaagacagccgtgacggtctaaatactctaaaatggtttttgacacttttcctcgtttttgaagatcctcttttgaaaggaactccccttcttcccgtgctttcacaatattgagagcggcgttggttccgagtcccggaattgagttgaacggcgggatgagactgttgccgtcaatgataaattccgaagcgctcgaacggtatagatcgaccttctggaaggaatagccgcgctcacacatttcaagcgcaagctctaacacggtaaggaggtttttctccttcggcgaagcatcaagccctttagagctgatatcatccatcaccgctctgatggcggtcgagcctttaatcattgtatcaatgtcaaagtcatctgcgcggacggtaaaatacgcagcataatataaaagcgcgtgatgcactttaaaataggcaatccgcaccgccatcagcacgtatgcggcggcgtgggctttcgggaacatgtatttgatttttttgcatgaatcaatataccagttcggcacattgttctttttcatttcttcttcccattccggcgtcaggcctttgcctttacgcacgaattccatgattttaaaggccagtgaaggctcaaggccctgataaatcaagtaaaccataatgtcatcacggcagccgatcacttcgctcagttcacacgtattgttgtgtatcagttcctgcgcgttgccgagccatacgtccgtgccgtgggaaagcccggaaatctggacaagctcggagaacgtcgtcggcttcgtatcctcaagcatctgccgcacaaatcgcgtcccgaattcaggaataccgagcgtccccgttttacagccgatctgctcttcagtgacgccgagcgattctgtaccttggaaaatcttcataacttccggatcatctgtcggaatcgtcttcggatcaattccgcttaaatcctggagcatccggatgactgtcgggtcatcgtgccccaatatatcaagcttcagcaggttgtcatgaatggagtggaagtcaaaatgagtcgttttccattcagaccccgtcgcatctgccgggaattgtatcggggaaaaatcgtaaatatccatgtaatccgggacaacgataatccccccgggtgctggccggtcgttctcttaacgccggtgcagccctgcaccagacggtcgatctccgcgccgcgcatgtgtaggttgtgatcacccgcatagcctttcacatatccgtaagccgtcttttccgcaacggtgccgatcgttcccgcgcgatacacgttatcttcaccgaacagcactttcgtgtagttatgggcatggggctgatactcacctgagaagttcaagtcgatatcgggtactttgtcacctttaaagcctaagaacgtttcaaacgggatatcatgcccgtcctttttcaaaggtgtgccgcaagacgggcagcttttatccggaaggtcaaaaccggaaccgactgatccgtcattaaagaattccgaatatcggcagctcgggcacacatagtgcggagcgagcggattcacttcagtaatttccgttaaggtcgccacaagcgatgaaccgacggacccccgggagccgacgagataaccgtcatccagagaccgttttacaagcttatgggagatgagataaataacggcgaatccatgaccgatgatgctttttaattctttttctattctcgcttccacaatttcaggaagctcttcaccgtaaatgcttctggcgcgctgatagctcatttcacggatttcttcatcggctccgtcaattttcggcgtgtacagatcgtctttgatcggtttgatctcattgatcatcgaagcgactttctgcgtattgtcaaccacaatttctttcgctttttccgcaccgagaaaggagaaagcatccagcatttcatctgtcgttctgaagtgcactttaggcagttcgtgcctgtttaacgggttggcgccgccttgggaagatattaagatcttccggtaaattttgtcctcatcgtttaaatagtgaacatttccggtggcaacgaccggcttattcaatttttccccgagcttcgtgatgttggcgatgatttctttcagcgctttttcatcccggacgagctcaagctgcagaaggtgtctgtatacttccggcggctgcacttcaagataatcatagaatgatgcgatatcttcaacctcttcaggtgatttttgcatcatgccttcaaagacctctcccctgtcacaggcagagccgattaacagaccttctctgtatttattaagctgcgacctcggaatgcgcggcactctgtagaaatattgaatatgagaaatagacacgagcttaaacagatttttaaggccggtctcatttacggcaagcaatgtagcgtgataaggccttgatctttgataagcattggattgtcccatattctcattcagctgatcatgataaaaaatgtctttttcagcggcatctttgagcattttcaacagcaggtagcccgttgcttcagcgtcaaagaccgctcggtgatgctgggttaattcgatatcaaacttcttacataacgtatttaagcggtgatttttaaactcaggatacaggaaacgcgcgagttccagcgtatcaatgactggatttttcgctttttccgttttcagtagacgcttgtacgccacatttaaaaatcccatatcaaagctggcgttatgagccacaagcacgtcatcgccgatccattctttaaaatcccggacgacgtcaacgacatcgggagcgtcgcggaccatgtcatccgtaatcccggtaagctctatcgtcgttgctgacagcggatggtgcggattggcgaacgcttcgaatttatcgatgatttctccgcctcttattttgactgcggcaagctcaatgatggtgtcatacactgcggacagacctgtcgtttcaacgtcaaagacgacgtatgtgtcttcttccaaaagacggtgagctggattgtatgcgatcggaacaccgtcatccacgatattggcttccattccgtaaatcattttaatgccgtgttttttcgcggcggaataggcatccgggaaagactgcacaacggcatgatcagttaacgcaatcgcttcatgtccccattttttcgcctgttcgacaagctttccgatgcccgttacagcatccatttggctcatcggagaatgcagatgaagctcaacccgtttttcgccttcaggagcggtgtcttcacgggttttggcttttatttcattcacgtcatttgcaatcatgacgaggtctctgacgaatgtatcgttttgaatgcttccccgcgccttcacccacatgccttttttcagcgttttcatcaaagcggcgtcttctttttctctggcgaacatttttactaaaatactgtttgtatagtccgtgattttgaaaatgcagagcgtgcgtccgcttttcagctcgcgtgtttcagcatcaaacacaaacccctgcaccgtgattcttctttcttcatccatgatgctgtcaagcgtccggatttcttcgttctctttaatttgatagccgatgacaagcgggccggacggcgcttgatcctcatcgccctctttttccttcttctccatttcgataagcgcctgcatcgcccgctcctgatcttcagcaagcttttgctcgcggaatttctggacttcttggtcagatacgaaaatttcggtatccagctgcagttccggaaatccgaattggcgatagctgtgctgaatcagtgcgctgtatttatttttgagcgccgatgcttctgtatctgtttttgttttcacgatcagtttgtttcccttgagcttcggcttctgctgattcaaaagagccaccatcggcggcgaggttccttcaagctcttcaatacagcgtgtccaataatcctgtacaagctcctctgtcactgtaggatcgatgacctgaacagacgatgtgacacgggcgatgtgagcaaacgattgtgttaacctcatcatgaatgaatcgtatatttgatacggcaaaagagccttaaagcgaaattggaaatgccaggctttttctgctttatggattgtcagtttatcaatctctccgtcttcaaagtatgtcatgaaggtatcatctgtcatattaagctgctgcagaagaatctgaaactgtcttctgtttactgataactgttccattcagacagtatccctcccttaaaacatcataagtgaaggtacctccgcaggtgatgaggtaccttcttttttctctattttaacatgattttgtacgattcgttatggtgattacttcgtcttaataaattcagaaagctcatccactgaaacttcagcagattcaccggttttgcggattttcacttctacgatgccttcgtcggcacgttttccgacagtgatgcggatcggaaggccgatcagatcagaatcagcaaacttcacgcctgcgcgttcagcgcggtcatcgtataaaacctcataaccttccgtctggaattttccgtaaagctgttcagcaagctctttttgcgcttcatttttcatattcagcgccaaaatatgaagatcatacggagcaacgctcttcggccagatcaagcctttttcgtcgtgatgctgttcagcgatggcagaaagcgttctggacacgccgattccgtaacatcccatcagcatcggctgcgcacgcccgttttcatcaaggtatgtcgcattcatcgcttcagagtaacgcgtgccgagtttaaagacttgtccgacctcaatcccttcagcgaaacggatcgtgccttttccgtcaggtgacggatcgccttcctgaatgattcgaagatcggcatacgcttttacagacgcgtcacgttcgatgtttacgtttcggtaatgacggtctttttcattcgcgccgcaaacggcgtttaccattactttcacggcttggtcggcataaatctcaatgtcgccggcagcgccgatcggccccgcaaatcccggctccgtgccaagtttctccgctacttcttcatgagacgcaagctcaaccacttccgcgttcagaaggtttttcactttcacgtcgttgacctcatgatcgcctcttactaacacgagaacaaatcggtcatccgctttaaacagcattgatttgatgcaggcgctcggctcgatctgcaagaacgaagcgagctcttcaatgcttttgacatttggcgtatcaattttctccaatgcctcgggtgtttcatctgacggctcgctgttcatgacaactttcgccatttccgtattggctgcgtaagaggatccatcggaataagcgatggtatcttccctatttcagaaagagccataaattcatgcgtgtcttttccgcccatcgcgcctgagtcggcaataacgggacggacgtttaattcacagcgtgcgaaaatgctgctgtatgcgccgtacatgttttggtacgtttcctccagactttcttcagaagcatggaaagaatacgcatctttcatgatgaattcgcgtccgcgcaataacccgaaacgcgggcgtttttcatctctgaatttagactggatctggtaaagagtgagcggcagacgcttataagatttcacctcatcacgcacgagagaagtaatgacttcttcatgtgtcgcgcctaaagcaaattcacggccgtggcggtctttcagacgcattaattcaggcccgtacgtataccatctgcctgattcctgccatgtttcagcctgctgaagggccggcatcagcatttccaccgcgttgattttttccatttcttcacgcacgatcttctgaatgttttgaatgaccctgtaagccaggggcatgtagctgtaaaccccgctcgtattttgtctgataaatcccgctctcagcagaagcttatggctttttgcttcagcatcagccggcacttctctcagggtcggaataagcgtcaaactttgtctcatgtcttcgcacctctgattttttactagtcaattataagaataaacgctggatatcgttccatgtgacaaccagcataagaagcattaagaaagctacgccgataaatacgacaaatgcttccttgtcacggtttatcggcttgccgcggattgcttcaatgaataaaaacagcagccgtccgccgtcaagcgccggtatcggcagcaggttgacgattcccaggttgatgcttaaaaacgccgcaaactggaataggttgataataccggtttttgcaacttgatccgtcatatcataaatgccgacaggacccgaaagcatatcaagcttaaactggcctgtcacaagtttgctcagattggtcaggatcgcttttgtgacatcaacggtagatgtcgcgccgtaagcaatcgctgcaagcgctcctttttcagtcggcgcataagagccgaagcggccgattgtttttttattttcatcttttacagcttcaggtgtaaccgagatatgaaacgatttgccgtcccgtttgacggcgacatcgatttttttcccgggattttcttttaccgctgtcacgatgtcggtccatgacctcattttttcaccgttaatgctctggatatagtcgccttcttttaaaccggcagcagctgcgcgtccattgtctgtcagcttcccgagctcaggctgatttgaaggcacgccttgaatgaatccgagcatgacgagaatgacatacgctaagatgaagttcattatcggaccggcagcaatcgccttaatccgcttccatacgggtttagacccgaattgtcgattgtaaggcgcaatctgcacttcttctccgtctacgataaaaaaagaggtctgactgacagtaaagcccgccagttcatcttctttcccctgctcgtacccggtaatcttcatttcgtgctcaagatcagccgtctccacctcgataattaaagcgtcgggatatttttccttttgattaatgatgactttttccacttcgtcatctttattaaaaagaagcccgacggtataaccgggtttgacttcgatcatctccgggtcttcaccggccatgcggacgaaccctccgaccggaaggagtctgatcgtatacacggtttcattctttttaaatgaaaagattttagggccgaagccgatcgcaaattcacggcaaaggattcccgctctttgggcgagcaataaatgcccgagctcatggaaaaaaacgagcgttccgaaaataataataaacgcgataactgtattcacgaacataccaccttatgtgagtattgaattaacgtatccccgggtgtctttgtccacttcttggatatccgcaagactcggatcctgaattacgctgtggcggtccaatgctttttcaatcaggtcctcaatcgataagaatgaaatccgtccggcaagaaaagcggcaacggcttcttcgttggccgcatttaaaaccgtcggcatcgttccccctattttacctgattcaaaggcaaattgtaagcagcggaacctttcaaagtcagctttcgcaaaatgaaggcttccgatctcccataattcaagcctttttgtttcaggcagaggcagccggtccggatatgtcagcgcgtattgaatcggcaccctcatgtccggatttccgagctgggcgatgacgcttctgtcgtgaaattcaaccatcgaatgaatgatgctctctttatgtaatacaacgtcaatctgttcatacggaatgtcaaacagccaatgcgcttcaatgacttcaagccctttattcatcattgtagccgagtcaatcgtaatctttgcacccatcgaccagttcgggtgattaagggcgtcggcaatcgttacagactcaagctcctgccgcgttttatccctgaaactgccgccggatgccgtaatgatcaggcgctcgatatttttgctctgttcgccttgcagcgcctgaaaaatagcggaatgttcgctgtcaaccggaagaagaggaacaccgtatcgttttgcgtgtcctttcactatatgcccggcagtgacgagagtttccttatttgcaagcgcaattgtttttttctgttcaatcgctttcaaagtcgggattaaaccgacgcttccaagcagcgcattgaccacgatatccacttcgtccatgactgccgcttcaatcaggccttcttctccgatgccgatttgacattcatgcgaaaaagacgcttctttcactttttgatatgtatccatgtcgccgactgctacatatttcggctgaaacgttctgatcaacgggatcgctttctcggcgtttttaccgaaagtcatcgagacgagacggaactgatcttgatgcatgcgcaatacgtctaacgtctgctccccgattgatcctgttgctcctaaaagacaaatattcttcaaaatgccactcccattctatgcgtccagatcggtcttattttcatattagcctttctcatgaaaaaagcgcaagcagaaagtataagaacggcatgacaaacaaaaagctgtcaaatcggtctaaaatgccgccgtgcccgggaaggattttccccgaatccttcacatcatagtgccgcttaagcgctgattcaaccaaatccccgatctgtccgaacacagacagaacaagcgtgatgaccaaaagaaccggatatgaaatcggaaggtgagcaaacagctgaaaaacggccgtaaaaataagggcgatgacaataccgccgagaaacccttccactgttttgttgggactgatttcgggccacagcttccgcttcccgagcgactttccgacgaaatatgcgcctgagtccgttgaccatatgacaacgcaggcataaaagatatacaaaagcccgtttgtttcaatgtttctgatttcaataaaataatgaaaacacagtccgatatataccgtcgcgagaacgataaacccgacttcgtcaaacgtaaaggtgtttttcacgagcaccgtatagctgagcagaatcaatacggcgaaaatcgttacttccattttcgcatcgaaaaaatgatatttgtccggcatcatatacagccataacaacaagaagctgatcagacccggaaaagaaaaaaatctgagctttttcatccgcaaaagctcaaaaagcgctatacttcccatcacgtaaacaaatacggtgaacggcaatcctccgaaaataaccaaaaataaaaatagtgccgctgccagaacacctgttaacagtctttgtttcatttccaccatcctctaaattccgccaaacctccggccccgctgctgaaattctcccactgcctgcagaaagtgatcttctttaaaatcgggccacaggacatctgtaaaaacaaattcactgtaagccacctgccaaagcataaagttgctcagtctgatttctccgctcgttctgatgagcagttccgggtcctggattgattctgtcattaaatgcccggaaaagagcgcttcatcaatgtcttcgatattcagcgtgccgcttttcacctgttcggccaatgcttttgccgcattgacgatttccgtgcgtccgccgtagttcaaagcgaaattgagaatcagcccgtcattttgttctgtatcttttacggccttctcaatcgccctgtacgtatgagaagggagcgcggattcatctccgataattttcacctgtacattttcctctatcaattcaggaagatacgtattcaggaactcttccggaagcttcatcaaaaagtcgacttccatcttcggtcgcttccaattctccgttgaaaacgcataaagagtcagaactttaacgccgagctgatttgcgagctttgtcaccctttttaccactttcattccttcatgatgtccggcaatccgcgggagtgagcgcttcttcgcccagcgtccgtttccgtccataataatggcaatgtgtgcgggaatttcacccttcagtatgtcttcttttgtataccgttctaagttggaagccgcattctgctgattcttccaatttttgagtatgttgagcatgagattcctccgtcacccaaaaaggttgcgttgctgatgatcaatgtaatcaacagtattaacaaaaaaaccccctgtaaacatgagagggtcttttcacattatctattgtacatagtttttcattaaacttccatgatttctttttctttgtctttcgtgacgctgtcaatttttgacacatattcatctgtcagcttttgaacgtcttcactggaagcacgaagctcgtcttctgtaatgtccccgtttttctcaagttttttgaggtcgtcgttgctgtcacggcggacattacggactgctactttcgcttcttccgcgtattttttcacgactttgacaagttctttacgtctttcttccgtcagagccgggatcgcgatgcgaataattgtgccgtcacttgtcggagttacgccaaggtcagctttcaggatcgctttttcaatatcgccgattgccgttttgtcatacggtgtgacaacaagcatacgcgcttcaggcacattgatggaagacagctggtttaaaggtgtttgggcaccgtagtattctactgtcactttatccaatagagatgggttggcacgtcccgcgcggactgacgccaattcacgtgaataagcggcaaccgctttttccatgcgttcttttgtttgtgttaatacttcgtttgacaacgttatttcccccttacgatcgttccgattgattcgccgattacggcacgcttaatatttccttcttccataatagaaaagacgatcagcggaatatcattatccatacatagtgaagaagccgtagaatccatgacttccagcccgtcttttaacacatcgagataagataatttttcgtatttaacagctgactcatcttttctcggatcggcattatacacaccgtcgacattatttttcgccattaaaatcacatccgcttcgatttcagcggcacgcagcgctgcggttgtgtccgtagagaaataagggtttcccgttcccgcggcaaaaatcacaacgcgttttttctccaggtggcggatggcttttcttctgatataaggctcagcgacctgacgcatttcaattgatgtctgcactctggactgaattccgagcgtttccaggctgtcctgcagggcaagtgagttcatgacagtagcaagcatgcccatataatcggccgtcgcacggtccattcctaagtcactgcctgtttttccgcgccataagttgccgccgcctacaactacggccacttcgacgtcaagctcagcgatttcttttacctgtttagcgatggattggataacagtcggattaatgccgtttccctgctctcctgccaatgcttctccgctaagctttaaaacgatacgattgtattttggtttttccataataacctccaagtgtaaacattgccgtttcctattatgcaagagaaaaaaaggtttgtaaatatagttttaaaaatagggaacacaagtagtgtcccctatactgcctgaaaagccgcgaaagattcgccaaggctttccgccattattttttcacttggttcataacttcttcagcaaagttttcttggcgtttttcaatgccttctccaacttcgtagcggacgtaagttttaacagatgcgtttttcgcagccacaacttgtttcactttttcgtctgggtttttaacgaaagcttggtctaataagcaaatttcttcgaagaatttgttcagacggccttcaaccattttagctacgatgttttccggtttgccttcttgaagagcttgctgagtcaggatctgacgctcatggtttgcttcttcttcagacacttggtcgcgggaaatataacgaggatttaccgctgcaacatgcatcgcgatgtcttttgcaagatcttcgtcagttgttccgctaagaacggataatacgccgatgcggcctcccatgtgaaggtaagcaccgaacgcttcgctgtcttcttttgtaagaacagcaaaacggcgaagagtgattttctctccgattttagcaacattgcttgtgatgtattcttcaacagtagaaccgttttccatcttttgacccaacgcttcttcaagatcagcaggagcgtttgcaagaaggtggtcagcaagcgtgttcagaagctctttgaagccttcgtttttcgcaacgaaatcagtttcagagtttacttctaagataacgcctttgttgccgtcagttttaataagagtagaaccttcagcagcgatacggtcagcttttttagccgctttcgcaattcctttttctctcagaaggtcgattgctttgtccatatctccgtcagtttcagtcaatgcttttttacagtccatcataccagcgcctgttttttgacgcagttcttttacctgctgtgcagtaatagccatttgaattcctccttatatgtgtaaacaagatatgtatagatacatttttcttgaaaaaaggtgataaaaggcagtccctcttatcaccttttgattaggttacgcagttgtcgtttctgtttcaggtgcagtctcttcagcagcttccgcttcttcttcgccttgcttcgcttcaagaatggcatctgccattttagaagtaagaagtttgacagcgcggattgcgtcatcgtttgcagggattacgacatcaatttcatcaggatcacagtttgtatctacgattccgatgataggaatgttcaatttgcgagcttccgcaacagcgatgcgctctttgcgaggatcgatgatgaataatgcatcaggaagatccttcatgtctttaattccgccgaggaatttttcaagacgctctaattcttttttcaattgaacaacttcttttttcggaagtacttcaaatgtaccgttttcttgcattttctcgatgtctttcagacgcttaatgcgtttttggattgtttcgaagtttgtcagtgtaccgcccaaccagcgttggttgacatagtacatgccagagcgtacagcttcttctttaacagaatcctgagcttgtttttttgtgccgacgaaaaggatttttccgccttcagcagcaaggtttttcgtgaagttgtaagcttcctctacttttttcactgttttttgaaggtcaatgatgtagattccgttacgctccgtgaaaatgtaacgcttcatttttgggttccagcggcgtgtttggtggccgaagtgaacaccagcttcaagcaattgtttcatagaaataactgacatgtgatttcctcctaataaaatggtttttttcctccgcttaggtcatttttgtgcagaactgccgtttgcagcaccctctgcataaatcgttaagcgtgtgtatttaacaccaagacataatataacacagctttatgcgacaatcaagaatcctttacagctttgccgcgaaattttaaaaacagctcgatttctgtctttccgctctgcacccgtttggcgatttccgcaggggtgagcccttgttcatataattctgaaacacgttcttcaaacgaatgcgcaccgttgttttcgtcactttcagcccgttccgttgcactgatgagcttttccatgtgatccggaatatcaggctcttttttcggttccggccggggttcggcgtcttctgcgtcaggcgcttgatcattccggctttttgtgtcttcgagtctttcattttcttctttcagctcaagcagaaacgctgcaagggtgttttccgtctcttcaagaatcttcttctgctggcgctccgtctccttgagggctgaaaacctcgtgtacagaataatgacggcataaagcagtacgccgtgaagcacaaagcttaaaagccataatagtgttgacatgtttttcactcgctaaccatgagttcattattgaattactttttcaagcaggtgctttaatttaaacagcgcctttgaatgaatctgtgaaatccgcgacgtcgaaaggttcaggacttgtccgatttcggtcaaagtcagttcttctttatagaataaactgacgacaagctgctctttttcagagagctcgtgaattttgcccgcaagctgagcgatcagctcgtccttcatgattttttcttccggcggcacatttttgtcatctctgatcatcacttgaatattctcaccgtcatcctggtcgtgaagcttttcatcaattgataagagattggcaaaaaacccttcattcatcgttgatactacgtcctgctccgtcatcccaagctcttctgcgatctctgaaggcgtcacattccgaaggtagcgctgttcaagtttttcgattgccgcttcgactttttttgtcttctcccgtgaagttctgggcagccaatcttctttacgcagcccgtcgatgattgcaccgcgaattctaaacgaggcataggtatcaaattttaaatcccggccggggtcaaatttttctagggcatcatataaaccaagcataccaaggctcattagatcgtctttatgcaccgatttcggcagtccgacggaaattctgccgacatgatatgtgaccaaaggcatgtaacggcgcattaaatcatcaccggctttaggatctttccactctttccagcgcgaccaaagcacctgatcttcataattcaaggattgcattgttatccccctacctcatacctttattaaatcgttgtttcaccttgtttaacagttcgaatgtgcagcatgcaggactttggctcaaattcaatcgtccggccgcttgagccgcccgtatcttcactgatgaccggaatgttatacaatgaaagctgctctttgatagccgctacattcctcggaccgattttcatcaggtcgtttgtcattttaaacttaaacatctccgctcccccggcgagttttgccttcagggcaaacttgcggcagccggctttcaaaagcatatcaattgtcatcttaacggcggtgtccgcgtattttgcacggttgagctccgccgtttttgataaaccggagtccggcagcatgacgtgaacgagtcctgccgtttgtttgtctttatcgtataaaaccagccccacgcatgaaccgagtcccgaagtccggattttatccggataacgcgcgacttgaacatccgcaatccccactttaacgactgcggcttccgcacggctcataaagccgcacccaatgagacgaagagcttttcaaaagaatcatagtccgggagcataaacatatgggctttgagctcctgccggctgccctggtcaaaaatagaagtatccacgacaatggcatgctctccgacttggctgagctccatcagtccttcactgataaccgcgccgaacatatcaagtgagatttccggcacgctcgggtaaatctcaagctttgtcaaatcagccaatgccgttaaataggaacctgctaaaatattgccgaactcatgtaaagcagaagaactcaaatgatcttcgcccaactggtcaatatcaaaatccggatttccgatcagctctctgataaactgttccgcctgatggaaaggcatgatgagaaagatagagcctgtcatgtcgccttccattcttaaaaagatactggcgaccggcgtttcagccccgccgaaaaaatcagcgagctcatcaaatgtcaataaagtcgcaaacggcacttccatgtctatctttctgttcagcagctgagccatggcagaagccgagtgacccgccccgatatttccgacttcccgcaaaatatccatctgctcttctttgatcgcttcaaacttactcatgttgtcttttcccctttaagcattcggctctccggacgcagatgccgaagcacctttatccagcaccgcatgcgcatcaataatattgaggagcctgttatcttgcttgacgatctgtttaatccacacatccgtttcctttgtctggctttcaggcgcggattcgatttcattttcatgcacggtgatgacgtcattggcctcatccacgacccatccgacatcggcgtcacggtaagaaatgatgataatccgtgtctcttctgtgatgtcctgttcaggctggttcagacgttttcttaaatcaagaaccggggtaattactccgcgcagattgataacgccgcggatatacgattccacacccgggaccctcgtcggtttttgccacttttcaattgatttcacctgggaaactgagatagcgtattctttcccgtttatcataaacacaatcattttttcacctgttttgatttcagcagtcatgcgggcacctcctcgtgtcgttttagtagatcagcgcattgcaatcaataatcagcgccacttctccgtttccgagaatcgtagcgccggaaatcgcaaagacgttcgtcaaatagtcgccgagtgatttcagtacgacttcctgctgtccgataaaagagtccacgacaaaagcagtggatttatcgccctttttcacgacgattacatggaactgatcggcatcctgttttgaatctgtaatgccgaattcttttttgagatagacgatcggaacgatttgtcctctgaaatcaatcacttctctgtcatgcgtctgcaggatatctttcttatcaataacagccgtctctataatagaagaaatcggtatcgcaaacgtctcttcttccagtttaatgagaagaacggatataattgaaagtgtcagcggaagctggatactgaaaagagaaccttggccttccgcggatttgacactgacagagccgccgagtgattcgagtttattttttacgacatccagaccgacgccccgacctgaaatgtcagaaatttgatcggcagtcgagaagccaggagcaaaaataagctcgtaaatctcattatcttcaagcgtttcagcatcacgttcggtaattacactccgctcgagcgctttttcaagaattttctttctgttcaggccggccccgtcatcttcaacttcaataaagacatgattgccgctgtgatatgccttaagcacgacatgacccgattccggttttcctttattcacccgcacttcaggcgattcaatgccgtgatcgatgctgtttctgattaaatggacaagcggatcgccgatttcatcaatcaccgtgcggtccagctccgtttcagctccgatgatggacaattcgattttcttgtttaattccttttgaagctggcggatcattctcgggaaacggttaaagacggtttctaccggcaccatccgcatattaagaataatagactgaaggtcgcccgaaattctggtcaggcgttcaacggtttcagtcagctcattgtggtcaagctctttggcgatctgctcaagacgtccgcggtcaatgacaagttcttcaaaaaggttcattgaagaatccagtctttcaatgttgacgcgaatcgttttcgagccgctgtgatgcttcggctgctcttccgttttcgcttgcggtttcggctgtttttcagcctttttaaccggagtttccttcaccggttcagctgcttgcggtttttcggccgtttttaacggcgcaccggcagaaatttcgacattctccacttctgaaatgccgctgatgagttctttaatttcttcagcaggctgctttgtcaagaaacacacctgaaaatccgttccgaaatcttccgtctcaagcacttccgcggcgggtatcgtttttgcaacttccccggcttcattcagcttttcaaatatcatgtacacgcgcacggctttgagcatgcagctttcattcagggaaaccgttatttcatagcggctgaatccttgctcttccgcctcttcaataacagtccgttcgaactcatcataattccattcagttgaagtctgttgttttgaagccggcggttctgctgtttcggctgaagccgcagtctcatgcgccgcatttacgtcgagcttcgcacttacttcagaaatatcacgtttgccgtctcctccgtcaataatggactgcaccatctcttcaagatgatcaagcgcttcaaacagcacgtccagccaatccgatgtaacgggcatttctccgttgcggatggcgtccagcacattttccatcaggtgggttaaatgcgccagatctgtatatcccatcgttgcgctcatgcctttcagcgtatgggcagctctgaagatgtcatgcacaagctgaaggtctgccggatctttttccaacagcagcagcttttcgttacatgtctgtaagtgctctttactttcatcaataaagacatctaaatattgattcatatccaattgattcacaccctctcttttttcacacatccggtgatggatgccgcgatatcttccacatgtttaatctcatgaatgaggcccgcctttatcgctgacttcggcattccaaacacaacacaggattcgtccgattccgcaatcgttttaacgccgcctgttctgagcatttcttttacgccctcggttccgtcgctgcccatgcctgtcataatgacggctaccttttcgtaaccggataaacggcttgccgaccgaaacaaataatcggctgacggtttatgccggctttccgtatcatgaacatcaagaatgatgcggagccttccgccttcctctgcaaccgtcatattttttccgccgggcgcgatgtacacccatccgtctttcgcttcttcaccgttttccgcttctttgacctgaatatctgacaaatggttgagtctgtctgcaagtgaagcggtgaagccttcaggcatgtgctgaacgacaaatacaggcgcctttaaatccttcggcagtttcggaaccaccttttgcagagcccgcggtccgcctgtagaggtcgcgatgaatacggcctgcttggcggattttgctttcggtctttcaaatcccgccaaagccggacgttccgggatagaagactctttcactgccgcctcaggtttttgtgcgcgggacatcccggctgcaatcaccctctcaatcagctgctctttaattttataaagatcaagtgaaatcgctccggaaggcttagtgataaaatcaaaagcgcccatttccaggcagttgatcgttcggtccttcccttgctgtgtctggctcgataccatgatgacgggaagtttatatatgctgatgatcttccgcaatgtatccgttccgttcatgaccggcatttcaatatcaagcgtgacaacatccggtttgagaagctctattttcttcagcgcctcttccccgtttctggctgtcccgatgacttctatctgcacttccgcagccagaaaatcggtaatcatctttctcataaaagctgagtcatcaacgacaagcacacgaatcactgtaaagtcctcctcaataaaaaagaagataatctctcaataaatgccggtttctcttctcttggtttgttttcttccgtttgaaacaagacatccgtcagaagacggacggacctgctggcttttgcttgaggactttttattaaaaaaggcacctggtcaatgacggcttgacttactagcggatcatcgggtatggagccggcgaaacgcacctccgcgcctaaaaacgtgtggatcgcatgagaaaggcggttgtacgtgtccagcgcctgtttttgagcgcgggcgcgattgacggcaatgtttacggtcagccgttcatccgcgagcaaaagatgtttgatcgcgctgtacgcatccataatggccgtcggctcaggcgttgtcacggcgagaatgtcttccgccgataaaataaacggcagctgttcttttgaaagtcccgctcccatatcaaacagaacgtaatcaaaatcgcttaatacagcggaaagaccattcataaaagccgaccacttctctctgtctgcttgatagaacgcctcaagccccgttcctccggatatgtagcgaaggcctttcggaccggaggaaagtgattgagccaacgcgtgccgattctccatcacatcaataatggtgcgggaagaagcagctccgatcagcacatcaatgttgcccattccgatgtcaagatcaatgatgagtgctttttttcctttttcctgcagggcaactgccatgtttaatgttaaattagattttccgacgccgcctttaccgcttatgacggctaatgtcctcgcttttttctcataaagctccggcttgatcatttgcctctctctcattttccttcttaatgactctgcctgatcgggtttcatgccaaaagcatccttacaaactcttttggtgaagccgataggatgtcttcaggcacatcctgtccatttgtcaaataggcggcgccgattcttgattccgacagcacttgaaacacggagccgagtgaggcggtttcatccgttttcgtgaaaatgaattgattgaccggcacaccggaaaactgtttcagcacctgtttcatatcttcatattttgcagatgccgataatacgagaaaggattgtaagcctgattcaaacggaatcatctcttgtaattccgtaatatactgctcttctttaaagtttctgccggctgtatcaatgaaaacatggtcgtattcagcgaatttttccagtgccttcagacattcttcctttgaatagcatacttcaagaggagcctgaagcagctccgcatatgtcttcagctgctcgaccgcggcaatccggtaagtatccgtcgtcataaaggcaatttttttatgctctgtcagcattgatgaggccgcaagtttcgcaagtgtagtcgttttgccggccccggttgaaccgaaaagcacgacgtattttgattgaatcccttcctgccacctgtctgtcgaagggagttttttcactaacaaatcctgcagctttgagctgacattatcttcagttaaatctccggaaacaattgaagaactgagcaattcactgagtacagcgttttgcgtatgatcaggaagcccggcttgcttcaatagtctctcggctttttttaatggttcagggagcacttctttcaaatgcgccagttcgccggaaatactttgatccggaaggcgcggcggctgaacaggctcagctttctccgccgtttccgtctttttcatttcttcagcggcagccggcggcgtttttctcgcttccctgacgtcacgatctaaaaccgctatcacttcgacggcctgctgcgaccgcagccccagccattttcgtttctttacttgtttggaatgtaaaataacggcatcattgccgagttcctttttgatttgcttcgcggcatcctgcattgaagcggctgtaaatttttttattttcattaaatatccaccactccaatgctctgtacttcaacatttgcttccagctcattataagaaagaaccggaagatcagggaaataccgttctaacagctgttttacatacattctgacagcaggcgagcaaagaagaatcgccgactcctgacggatggaaagctgctcggcctctttagcgacagaacggatgatgctgtccgaaacctcagggtcgagtgacaggtaattgccctgttcagtctgctgaaccccgtctgcaatcgctttttccacccggcctgagcatgtgatgaccttcagcgtttcatgctctctcgcatattgtgccgtgatttgtttggcaagcgactgtctcgcgtattctgtcaaaaggtctgaatctgtcgttaatcttccgtaatcggcaagagtttcaaaaatggtcaccaagtttctgattgaaactttttctctcagcaatttggcaagcaccttttgaatatcgccgacagaaagagggttcggcgtgacttcctcgacaagcacaggataattttccttcagatgatcgatcagctgctttgtttcctgtctgccgaccagttcatgagcatgctgcttaattttttctgtaatatgcgtagatacgactgacgccggatcaacaactgtataccccagcatgtccgcttcatcttttgcagcttcgctgatccattttgcgggaagtccgaacgacggttcaatcgtttcaattccttcaatgacgtcatcttcaggcgtcggtgacatcgctaaataatgatccagcaggagctctcctttagcgacttcattgcctttaattttcaatctgtattcattcggctggagtgcgatgttatccctgatgcgcacaaccggaatgacaagtcccaattcaagcgcaagctgacgtctgatcatgacgatgcggtcaagaagatcaccgccctgccccgcgtctgcaagcggcacgagtccgtatccgaactcaaattcaatcggatcaatatgtaaaagctgcacaacgctttccgggcttttcagttcatccgcctgagcctcttcttcaagaatttcttcctcttcttcgctcggcttatccgctttggacagcatataagcgccgaatgcaagcagaccggcgatcggccccgtcagcagaatgccgatcggtgtaagaagaccgagcaaaagtacagttcccgcggctacatacaagagcttcggataagcaaacagctggcctgtaatatcatgaccgaggtttccttcagatgccgctctcgtcacgacaatccccgtagccgttgaaatgagcaaggccggcatttgagaaacgataccgtcaccgaccgtcagcattgtaaagtgagacgcagcttcttgtatgctcatcccctgctgcagcatgccgattacgattccgaaaataatattgatcatcacgatgatgatccccgcgatggcatcccctttaacgaatttgctcgcaccgtccatggcgccgtaaaaatccgcttcccgggcgactttttcacgtctgtgctttgcatcctgctccgtaatcatgccggcatttaaatccgcgtctatactcatttgctttccgggcatcgcatcgagcgtaaatctcgccgccacttccgatacccgctcggcgccttttgtaatgacgataaactgaataataattaagataatgaagacaacaagccctaccagcacatttccgccgacaacgaaattcccgaatgtctcaacaacctttcccccttctccgtgagaaagaatcgaacgtgtcgtcgacacattgagcgcaagccgaaacagcgtcaataacagcagcaatgacgggaatatcgagaattgcagcggttcttgcatattcattgtggtgagaagcacgatcaacgcaagagagatattaatgatgatcaaaatacttaacaaccatggagggaatggaatcaccagcattgccacaatgaggacaacacttattaaaaccgataaatctcttgttgacatgctgtttttctctccttttgaatctgaaattcgctatactttttgtttcgttttatatacataagccaaaatttccgcaatgactttgaaaaactcttccggcacagcctggtcaatgtcaacctgatcatataacgcacgcgcgagcggcctgttttcaatcgtcatgacatcgtgttctttggcgatctgcctgatttttaatgcaagatggtcgacccctttggcaacaatgtaaggggcggccattttcttttcatcatattttaaagcaatcgcataatgggtcgggttggtaatgatgacatccgctttcggcacttcctgcatcatccgcctcatcgccatttcccgctgcttctgcttaattttggacttgataatcggatcaccctccgattttttgtattcatcttttatatcctgctttgacattctgatatttttctcatagtcaaaacgctgatataaataatcaagcccggccagcagcattagagcccctgatcccgcaagccccatccaaagcgtgagcttagaaacgaaagtgagcacttccgcaggtgttaaaagcggaaggcggagaatatcgccataatgcagccagagcaccataaaggcggcaaaaccgaccacagtaatcttcaaaatggatttgaccagttcaacaatcgccctcatgctgtaaatccgcttaaatcctttcagcgggctgagcttattcaagtcaggcttgagaacttccgcagaaaacagaaaacccacctgcatgtaattgctcacgacacctgccacaagcgcgaccagcataatcggcgcgaggatgaggctgatatctttcaccgtatctacgaacagttcatgcacggaagatgctgacagatgtaatgatatcgatttcgtataaaacgttttaataaaggacagcagcctgtcccgcatataaggaccgagcgcgatcagcgaaagaaagataatcagtaaagaaacggctgtattcacatccgtacttttcgcgacctgtcctttctttcttgtatccttccgttttttcggagtggctttctccgttttttcaccggcaaagaattgcagattcagtctgagtctcatcatgtcacaccgaccaatgccaatagattccgcatggtttcaacggtaaggctgaagatgttgcggacgacgacaaacatcaccgccatacaaacgatcagcataataaagctcacggctattttcagaggaagcccgacaacgaaaacattcagctgcggcaccgttctcgccacaataccgagcgccaaatcaactaaaaacagactggccacaaccggcgcagacatttgaaaagcgataatgaacatggcattgaagctttttgcgataaaaagtccaaagtgatcatttccaaacgacggaaatgcctgatcaagcgggatatactgaaagctgtaataaatcccgtccaataaaagataatgggcgtttacgctgagcataaataacagcgccagcgtataaacgaattgtccgatcagcgggctttgcgttcctgattgcggatcaatgacattggcgatggaaaagcccatctgaaaatcaataaaggaacccgctatctgaatggctgtcatcatcatgaaagcaatcagcccgaggctcaagcccacaacggcctcttttatgacaagcagcatatactgttcccctatttctatttccggcgcatgtttcagcgtgctgaagcagatcaccgaaagaaaaaaagcaaagccgattcggtgaaccgccggcagattccgatgtccgaacaccggcaccgttacaaaaaaagcagagattctgataaagaccaataaaaaagcgggaaataaatcaatgatggaattcatttgattctaccctgcaaatcggttcagatgagagaacagatcagttgtgaacgaaagaatcgtcgacagcatccaaggaccgaaaaagatcagtccaagcatcaccgccacgattttcggaatgaacgcaagcgtctgttcctggatttgagttgtcgcttgaaagatactgacgagcaaaccgacgatcagcgcgatggcaagcagcggcccgctgatcattagtgttacatatacggctttttccgccatggaaattacaaattctgaactcacaattagcacctaccctaaaagctgtcaagcaaagatttcacgattaaataccatccatcgaccaaaacgaaaagcaatattttaaagggcagagagatcataaccggcggtagcatcatcattcccattgacattaagacgctcgccacgaccatatcgataattaaaaacggaataaaaatcataaagcccatttgaaaagcggttttgagttctgatatcgcataagcaggcaccatcgtcgtcaaaggaatatcctgaatcgattcaggttttttcattttggcatagttcataaacagcgccagatccttctgccttgtatgcttgctcatatactctttaatcggcttctcggcttttgtatatgcttcatcgagactgattttgttgtccatcagcggcgttaaggcttccttattaatctctgaaaaagtcggcgccataataaaaaacgtcaagaacagcgcaaggccgattaaaacctggttcggaggcatgttctgcgtcgccagtgaggttctcacaaaagacagaacgatgacgattctcgtaaagcaggtcatcaaaatcagaatccccggcgctactgaaaagacagtcaaaagcagcagtaatttaacagtggagctgacttcggtcggattgcttgaattaaaaagattaacgaattcattcatgatgataagggcctttcttctttccttcagaacggctttgtttcagctcgttcagctgttctttcagcgcttttgaaaacgacggaagcatcgtttgcggctttttttctccatccttacgcggatttacgagcttggtccattccacttttgaagacatcgactcttcgtattggctcagaatcgcctcgcgctctttttcatcttctatttcttttaaaagctgtatcgtttcgcccacaccgactacgagaacgctgtttcccactttaatcagctgcacggaacgattttggccgactgacgttccgccgatattttctacatattgaaacggcttcagcagacggtttcttctattcatcagtttgacaaatccatagatcagcagaatgacgaataataacgccccgatcatctttacaaaatcaaaagcggagacagaagatgcagaagcatcccctatctcttgatcagccgtttgtttcgatgtatcgctttttttctctgttttgtttgttgattgtttgtcaaaccattcgttgacggtggaattatcagactctgccgcaaaagcagggaacggatgtacattgagtaaaacgaaataacaaatcaaagctagtaaaccatgactctttttcaacagtcgtacaccctttagcttaatgttttattaatggcttcaagcacgcggtccgcttggaacggtttcacgataaagtcttttgcgccggcctgaatcgcgtcaataaccattgactgctggcccatagccgaacacatgatgattttcgcctgcggatcgatctgtttaatttcctttagagctgtaatcccgtccatttcaggcattgtaatatccattgtcactaggtcgggggaatgctctttgaatttttcgactgcctgcgctccgtctgaagcttcagctacaacgtcaaaaccgttcttcactaaaatatccttgatcatcattctcataaatgctgcatcgtctacaattaaaattctgtgtgccataatctgtttctctcctctatgttcgcttattttaaattgttaaggcggtctgcctgacttaaaatatcagtgactctcacgccgaagttttcttctatgacaacgacctcgccctttgccacgatccgctggttgaccaggatgtccacaggttcaccagccagcttgtcaagctcaataatgcttcccgcagaaagttcaaggatttctttgacgcttctcttcgttctgccgagctcaaccgtaacggaaagcggaatatccatcagcatatcaaggttattccttgatccttgcgccgcttcgttatgatcaaacgcctggaattctaccggagcgacttgaacaggagcagctttttttgcggttccctgtctcttcggaagctcgggttttgcctgcggctccggctgcatggcaggttccggctgcggcgtttcgtatgtttcctgtggttctgatgcggtttctgcggcctctgactcatgctggtccgcagtcatcaggtctgcgatcagatctttcgcaaacgtaatcggataaagctgcatgatgctcgaatcgattaattcgccgactttcagacggaatgacacttttacgagcaggtcatcctcaggtattctgtcggtccctttttcttccgtcacatccagaagttcaacccttggcggagaaatgtcaatctttttactgaatacggtcgacattgacgtagcagccgagcccatcatttgattcattgcttcctgcacggcgctcaggtggatttcaccgagtgacggatcggcgccccggccgtctccgccgatcatcaaatccgcgatgattgccgcgtcgctttgttcgacgacgagcaaattgctgccgtcaaagccttctgtgtagttcacttcaatggcaacatacggatgaggaaattcatcactgattttgctttttgaaatgacggtcacactcggtgtcgtaatgtccactttttgatttaaaagagtggacagcgccgtagccgagctgccgaacgaaatattcccgatttctccgatcgcatcgcgctcaagttcagacaagttcgcctcttgaggctgttctgtatcctctgactgactgcttgtgccgttaagaagagcatcgatttcatcttgagataatctattgttcatcttgttcacctcttatgtcgtgatctaaaatttgcactgcctgtcttcgattcacccggccggcctgccctaaaaacttcggtttgtttccgaccaatacagtaagaggatcagtcactgatttgtccagagttatacagtccccgacttccaaacttaaaaattcttctattgtcagttcagaagcgcccaagagagccacaacgggaatttgagccgtcatgatgcgcttttcaagcagcttcgtttcttcgggcttcgcttcattccggtctgattgcatccaataatgtacggaaagcttagggataatcggctcaagtacgacatggggaatacaaagattaatgacaccgctgatttcacctatctgtgtattgagagaaatgacaacgactgtttcatttggggaaaccatctgtacaaactgaggattcacttcaaattcagtcatttcagggtcaatatcagcaatcgattgccaagcttctttgtagttgcccagtgcattttcaaataagttagaaataatattcgtttcaatttccgtaaggctgtcagctttgttatgagtgatgccgatgcctcccatgacgcggtcaagcattgcgtatgcgatggtgggattaacctccatcatgattctgccttccatcggatgaacatcgaataaatttaaaatcgtcatgttcggtatggaacggataaattcttcatacggcacctggtcaactgagctgacggatatatgaatatacgttctgagcttggcggaaaagtgtgttgtgagaagcctcgcaaagttatcatgtatccgggttaaactgcgtatctgatctttcgagaatctgagagcccgtttaaaatcatatacctttacttttttctctttaacttcctttttcagctcttccgcatccgcctcacccgtggaaatggcggaaagcagtgcgtctatttcattttgggagagaacttctcctgacattttcttcacctccgtattctgtcaaatttgtttttattgcagattaaaggaggtaatgtacactttctgaacttttccttcttggagatagctgtttactttctcttttaatgattgtttaaacgcttctcttcctttatctccctcaatctctccggcgcttgtgtcagctaaaatggaaatgatgttgtctttcacctgaaaatcgcgtttttcaagttcttccttcgctttagccgagtcggtttcaagcttgatgccgatacggatgatgctgtcagactttaagtttgtcgtgatatcgtcgacagacacagtggctgcaacgacttcgtcaattgtcggctttttatctttgccggaatgtccgctgacgacaaaatatgctgccgttccgaggccggcgatgacaattaaaataatcagcaaaatgatgactaattttttcttcattcttcttcctctattccctgatccagtgaaaatatttgtatgctatggtaaaacgatatgacttttttgagaactgcttcttccggttctttcacaacgaactttttgccgttggacagtgtaatcgtcgtgtcggggaagcactcaatctgttcgataaacagcgcgttcagcgtaaaaggctggccgtttaaacgggtgacttgaatcatgcaatccggagaagcggcctaaccgcctctcctccctccttaccgtttcagattaaccagctcctgaaggatttcatctgaagtcgtaatgatttttgagtttgattggaaaccgcgctgagcaacgatcatttcggtaaattcatctgtcagatctacgtttgacatttcaagatagcctgccaaaagcttacccgttccgttttcgcccggagtggtgactgcgctcgcagctccggaacttaatgattctctgtaaaggttgcctccgattttttccagaccggcgctgttagggaacgtgaccagaccgatttgtccggcatcatgaaccgcatcccctgcatcagtgtatgtaacggttccgtctgcaccgatgctgtaatctttcgcatcagtcggaatattgattttgccgccgccgattttttcaaggtagtacccgtcagtcgtaacaaggttgccttgattgtcctttccgaaattccccgcacgtgtgtaaacgattcccgaacctgtattaatctgaaagtagccgtctccgtcaatggctaggtcggttttattctgtgtagcctgcggggcgccggttgaatgaacgacatcaatggaagaagtcgcggcacccaggccgatttgttttgaattggtcacgtttgaaccgccggcgactgtctggctgatcatatctttaaatgtaacgcggcttttcttaaatcccactgtgttgacgttggcgatgttattgccgattacatctagttttgtctgaaagtttttcatgccgctgataccggaatataatgaacgtaacatgttaaattccccctgggtttctttttatttagatgtttcgctgacggccgtgacattccacggactgacctctttgccattttcaagcacgagcacgtaattgccgtttgaatgcttgactgaattgactgggcttgtctgatccttcccgtcgctgtcgctgaatgtgacatttttgccgatccagttcacatacatcgtaaacggatcttgattttctacaaatttagtcatcgtcgtattcatattcatcatttgttccaatgaagaaaatgtcgccatctggctgatgaattctttgtcatcaaccggattgagcgggtcctggttttgaacctgtgtcattaagatcttcagaaattcgtctttccctaaattcgtactgctgtttactgcggaggtgctcttcgcgtttgaagtggttgaagcgcccgccgcggcataatccgagtttactgatgtcacctattcttcctccatttcattgagagaaagctcctccagcatatctccgaaatcgcctgactgctgcttgttcttctgctctctctgtccctgatgctgctgtttattgtgatcggccgtctgcccgtaaacaggctgctgatccccgccttgaagcgggactgtaaaacggtcgacctggaccgacatattcggaagcgactgtttcagctgaggaagatgctgttccagcagctctttcgcggactggctggatgcgattattttgctttgaaacatcccgttttcgtttgtcaccttaattgtgacaaatccgaggttctcgggattaagacgaatcgtaaagcttccggttgttttcccgaaaggcgtgtatttcatctgtttccagccgctgatgacctgatccgttaacggtttattttctgccggctgctgttcagctcctgcggacgcttgctgaatgccggcaaggcttctcgttcccgaaaacagtatatgtgcagacaatttgctgtcaggcgcctttgcgtgagaaaccgtgccgccgttttgctgttccgttttcccggctgactcttgggatgattcagatgattgagataacacaaaagctttcagctcagtttcagccatatcccattcctttgttcccttttgagaaaggcccgcaagctgctccgcgacgctttgaaagctcttcagctcagcggctgtcatggagtaaagtttagatgcagattcgtttttcggaaaaaatgtctgccgcaggtcttgaatcacgcggtccggaacaccttgttttttcaatgcctctaataaacgggcgccttcctggtaaaccgcctttgcctgcgtgctgtccggcagttcctgctgagatgtgaagagctggaatacggcttcttgaatgaaaagcaggcccttctcaagcgcatccttgacggaatccccgtcttttgcggaagaatccggctcattcgtttcaggcttcgccccatgctgttttcccgctaacatgtcttcaacggattcggcaagctgtttcaataaaggaagagctgtttcagccgtctgctttccttcaagagcttttaccgcctcaagcagctgtttaagctgcaattctttatcttccgggccggctttcagccaatcaccgattttcgatagggcatcattcagctctgcgtcacttgtttttgtttcatctccgggctgccggggagaagtgatttccgacaggagccagttctgaaatagacctaagctgtttacattcatcttcacattgctgttttgcgcagtctgcgtacgattacccgttaattcaagcagcttcaacttacatcactccttatttccgtcagcggatagtttttctgtatatttagccgcttgttcaggagtcattttcgtcaagatttcagcaagctgctttttacttaatccgtttaaaatatcgagggcttctttttctttcagctttacgataatgcttgccgctttaccgctgtccatacttttatagatgttgatcattttatcttttccggctgaatccgaagcgtcttttttcgtttcatccgtcttcgttttctgctgctgttcagcttcctgtttcagcgaacggattttctgattcagattatcgatttcggacttgcttgtatctaaatctttattcaaaatgttaatttcacttttttgttcctttatggtcttttcaagagaagccgttctgtcttccttctgcttttccgccgcgcttttcatttctttcgtttcgggaaccaattcttttaaaacaggcgttttagcggctgtttcctgaatcggcttcatcacatcaacgccggcagcccaaaggatgatgcttgcgacgatgatcagaaaaatcagcgggatcatgataaaaagcaggattgaaccgaactttccagatctcttttctttttcggccatttcattcgctcctaatgcccctgaatcataaactgcttgattgaaatgtcatccatttccctcatctctgcagctttgtcttcaagtgcgaacatattaaattgtttttcccgcattttttcaaatttctttacttcaatgtttttttcggtgagctgttcctgcttctcattcatttcatttcgtttcatgatgacaagcttttgataatgatagatggtgttctcaagattggaaacgaattgctgataatgtctcatttcctgaacgctcatcccgcatttcagctttgattctttgtctttttcgagcaattcttttttgctcatattttcatatagtttttcagccactgtctcaaattcagaaaccgattgtctgtattcagtcaatgtttggtctttttcattttcttttaattccagcagcttttgaaatctgaattggtacgccatgatgtttattcctcttttcctgtcagactcgtcaatgccgcaatgctgtcttccaattgagcaggttcttccgttccttgttttaaaaattgaataagctgcggataaaactgaatcgcttcatcaatttctcttgatgaccctcttttgtaagctccgatattaatgagatcttcagagttttgataagttgacagaagatcgcggaatttgttggccgcctctatgtgcgctgtgtctgaaatattagacatgaccctgctgatgcttttcaggatgttcacggccgggaactgtcctttgttggcaagcgcccgatcgagaacgatatgcccgtctaatattccgcgcaccgtatcggcaatcggttcgttcatgtcatctccgtcaacgagaaccgtataaaaagcggttatcgttccttgttcatttgcgcccgttctttccagcaaacggggcaaaatagcgaacacagaaggtgtatatccctttgttgtcggcggttctcccgctgccaggccgatttcccgctgagccatcgcgaccctcgtgacggagtccatcatgaacatcacattccggcctttatcgcggaaatactccgcaatggcggtggccgtatacgccgctttcaatcgcattaacgcaggctgatcagaggtcgcgactacgactatcgagcgtttcaggccttcttcgcctaaatccttctcgatgaattcacgcacctcgcgcccccgttcaccgacaagtgcgataatgtttaaatcagcttcagtctgcttcgcaatcattcccatcaaggtgctttttccgactccgcttccggcaaaaatcccgattctctgcccttttcctaccgtcagcagactgtcaatcgatctgacgccgacacccatcttttcccgtatcggcgggcgtttcatcgggtttggcggcggctgttccgtcgaaacgggggacaaacctttcggaagcgcccggccgtcaagaggttcgccgaacgcgtcgacaacttgtccgattaaacccgcccctactttgatgcggagcgactcgccagtggcctccacaatgctgcccggcgctatgctggccgcttccagataaggcattagcagaatgttttcatcctggaagcctacaacctcagctttaatcgcttttttcgcatggcctttcggataaatgagacaaacatctccgattgagctttcgggcccttttgattcaatcatcagcccgatgacccgtttaaccttgccgtagcgtttgtacggatccgctgtttcaattgagtctattaaatactgtgtcttcattgctccgctcccgcctcaagcgccgttaaaagcttttgctttaattgcatcagctgagtgtctatgcctgcatcaacacgtccgaacggagtttctatcgagcacgttcccttcgcggctttttcatcggcatataagcttaatctgcattctttgtataacagctgctgaatttcgtccatatgctgatgaaccgtctcataatattcagggtccacatagatggagatgtcatcataatcttttacttcggctactacctgtttgaccagcagaaggaaagcctctttatcgtcacttttttgccgccatacttttttagcgagcgcaacagaaagctcaataatttcttcctcagcgctttccagtttttcctcgactgattgtctggccatttccataacggcattggcccggctgatgagattggcatattctgcttgagcatcggcttttcccaatgccatgccttctttatatccttctgccttcgcttcttcaatcaatctttgtttttcttccgcccagcggtttttctcttcttcaatctgccgaagagtgtgatccaattgacttttcgcttcttcagacaccctgtcggcttcggccttggcaaaggccatgagtgcctccggattttcaggttcctcccggtctggctgggaatgtgttttcctgacttcctgcaaggatagcttgcgccgtttttgttcaggagaaaatgatgtttgctgtttaatgatattagacaataatatcgtctcctccgcctcgcgcgattacaatttctccggcttcttccagcttgcggacgacgcccacgattcttgattgcgcctcttccacatcacgcaaacgcacaggccccataatttccatttcctctttaaatgtttcaaccatacgctgtgacatattgctgaagacaatctctttgacttcctcgctcgcaaccttcaatgaaagcaggaggtcgtcgttttcaacatctctgatcacgcgctgaatcgcacggttatcaagggtgacaatatcttcaaagacaaacatccgttttttgatttcatccgccaattcaggatcttggatttctaatgaatcaaggatcgttttttccgttcctctgtctacgccgtttaacacttcaacaacggcttctatgccgccggtctgcgtataatcctgcgtaaaggaggaggacagcttttgttcaaggacccgctccacttcatttatgatttcaggagacgttctgtccataaccgcaatccttcttgccacctcagcctgaacgtccgggttcagctcagacaaaatctgtccggcctgcaccgggtcaaggtaggataaaatcagcgccatcgtttgcggatgttcctgctgaatgaaatttaaaatctgttcgggctccgcttttctcgcaaaatcaaacggctttacctgcaaagaagaggtgagcctgtttaaaatgcttaccgctttgtcttctccgagcgctttttcaagcacttggcgggcgtaatttaaaccgccttgtgaaatatagtcctgagcgattgcgatattatgaaattcttcaatgatttcatcttttctttgatgatcgacgcttctgactcccgaaatctcgagagtcaacctttcaatttcttcttcagacaaatgcttgtacacagaagctgatacatcaaggcctaaggaaatcatgaggatggctgctttttgttttcctgtaagcttgttctgatcacgtttcgccattttccattccccctaatcctcgtccagccagcttcgaagcaatttagcaaagtcttccggtttttctttagccattttttcaagctgttttcgtctgactgtttcttccgtttcaattttctcttcgttgatatcaggcaatcgaaccggctccggcggtgtttcatattcatattcttcgtattcatcctcttgtgagcgtttctttctgatgaggagaatgataagcagaataatggccgcaagcagtacgccgcctgtaatatatacccagatcggaagacctgaagattgtgccgaatctgtgttcaggcttgtttttccgtcaaacggctgaacggatacaacgattttattgttgatatcattgtctgtcaggttttgattttgcgtttcgtttttatcaagagacgttctgacgaccgttcctaaaatcttctgtatatcagcctgtctctgtgccgataaggaagcggcatttttcggattaggcggctccaccatgacctgaatgcctaaatcacgcactttatacgggctttccgcgatttctttatgaatgcggttgacttcatagttgattttattgctgcttttttcgtagtccccgctgtttgaaccgccgtttgtctcggcatagttcgcggtgtcattgcttcccgttccggccgtgccgccgttggccgcgccatcgcctttatacgtttccgcgactttttcggcgcttaccgctatgccttccatgttatctttatcgacaggttcgacagtgtcttcagtgcgtttttccttcgtgaagtcaatatccgccgttacagaaacaacgaccttatcctgccccatcattgtgccgagcagtgactgaacatgtttttgaatgtccttttcgacctgcgacttaataccttgctgagatgcataactgtcagaaacggaccctgcaccgctgtcacttttgtcataatatgtagaattttgatccattatgacgatattatcttcttttaagttcggaacacttttagaaacgagatggtacagcccgttgatctggttttgatcaagcgagtagcccggtttcatctgcaaaacgatggatgcggacgctgccggctgatcttcaccgacgaacacggcttctttcggcatattgatcatgaccttcgagcttttaataccgtccatttcatttatcaggtttgacaattcggtctgagtcgcctcaacctttaaaacgtcaaactcattatctgtcaggccgaagcccgcattttgtccgaaaaacgaataatcaattgatcccgttttcggcaggccttccgcggcaagctggactttaagcgaatccacttggctctcaggaacctttatgaccgtgccgccgtcagcaagttcagaagacacctttttcgtatcgagctcttctttaatcttccccgcttcttccgcggacaaatctttataaagaggcaccatcttttcagacgaagtaaaaataataacgacgatgagtaaaataatgaatgcggccaagccgcttaccatgagtatcttctgtgtttttgatctgttgttccaaaacgctgccgttttggttttcatttgcattagagtacgattcatgttaacccccggtcattccagtcattctcttcaatctgaccactacatctgcattctcatgatttcctgataggcttccacggctttattgcggaattcggtagcggccgtcagagaaatatttgctttttgggcagcgatcatgacctcgtcaaggtttacatcctttcctgcagccagttcgttcgttatttggtcagattttacttgtgactcatttaacgaatcaatagagttttttaaaagctccgaaaagcttgtttggtttgaagaatcagttttttgagtttggtttaattgattcgttacgttttgagtgttttgggtttgttgaagctgaaaaggagtaatagcgttaaccacttacatcaccttactttccgatttctaaagcctttaaaagcatgcctttggaggcgtttaatgcagttacgtttgcttcatatgatctcgtgctgctgacaagatccaccatttcttttaatgggtctacatttggtttttgtacatatccgtctttattcgcatcaggattctccggatcataaacgagattaaaagcggacgggtcttccgtaacgccagatacctttacgccatttcccgcgcttcctgttccgttcatcttggaatgtaaaagggacgaaaatgattcgcctccggattggagagataccagctttcttctgtaaggcacccattcgccatttacctgcttcgctctcgttgtgtccatattggccaggttggacgatacgacgtccatccggacacgctgtgcagttaaagcggaacccgaaatatttaagctttgaaagccactcattattttcctcctgtcaagacggttttcagagaattgaatttgccgctcattctttcaaccaaagcctgataattaatttggttttcggctaaatctgtcatttctttgtcgatatcgacattgtttccgttttgctggtacgatgtatcactgctggacacgatagaataatcgtcccttgaacccgtaaagtcaacgtgccgatagtcggtttttaccgcctcaagattggatgtttcctgatctaacaaatttcggaaagagactttttttgccttatagttcggtgtatctatattggcgatgttattagttaagactttttgcttaatgtccgctctccccaaggcattctcaagattttgtatagttccagaaaataagtccaaatccacttacctccatttcagatatttttctcctaaaaatccttgtcgagaattgtaaaaccatatgcttattgtaagaaataacaggcttaaagtctatgaagttaggctaaaaaaaagtgctcaattatatctattttgcatgtaggtattaagtcctagagtatttggactacaagtatttgtttaatataagactgaaaatagcagaatttctgtatcttcctccttttttcacacagcaagatggattatctcagatcagcttccaataagcaactttaaactgcaacttttcacctattgtccataaaaaaagcaggacccccattttcagggatcctgcttttgtcttaatgagatttaaggttttccaattcaataaggaatttgttgttcagaactttaatgtacgtccccttcatacccagagatctggattcaatgacgcctgcgctttccagctttctcagcgcgttaacgattactgaacgcgtaatgccgacacggtctgcaatcttacttgccacgagcaagccttcgtttccgtcaagctcttcaaagatatgctcaatcgcttcaagttcactgtaagacagagaactgatcgccatttgaacaaccgctttgcttcgcgcctcttcttcgatttcttccgctttttctcttaaaatctccattcctacaacggttgctccgtattcagcaagaatgagatcatcatcttcaaattgatcctgcagacgggacagaatcagcgtgcccagtctctctcctccgccgatgatcggcacgatcgttgttaagcccgcttggaacaggtctctgttttccacaggaaatgccgtgtattcgctgttgatatcaaggtttgaagacgtctccggaacattgaacagatttctcgtgtactcttccgggaactggcggtcttcaagcatttttttcatgcggtcattttcaatctgctgattaatagagtagcccaaaagctttcctctgcggctgacgacgaaaatattagaatcaatgacgtcacgaagcgtttcagccatttctttaaagtttacgggtttgcctgccgcagcctgcagcatgctgttaataattcgtgttttttgtagtaaagccatgataaataatcctcctagaattcctcttattaaattttcacaatataaattgacttagatctttgttgtttgcaatcgttccgagcttttcttcaacatattgcggcgtgatggcgactttttccatcgtcacgtccggcgcttcaaacgacaggtcttccaagagacgttccaatatcgtgtgaagccttctcgctccgatgttgtccgtatcctgattcacatgataagccacttcggcgatcttacgaatagcttcgtcagaaaattcaagagatataccttctgtctgcaataaagcctgatattgttttaacagcgcgttatcgggttcgacgagaatcttcacaaaatcatccaccgtcagcttgctcaattctacacgaatcggaaagcggccctgcagctccggaatcagatcagacggtttggccatatggaatgccccggctgcgataaacagcacgtgatctgttttgacggagccgtatttcgtgacgacggtagatccttcgacaatcggaaggatatctctttgaacgccttctctcgatacatctgctgaggaagaagcccctccgttttttgcaattttatctatttcgtcaataaagataatgccgccctcttcagctcttaacacggcctcttggccgacttcatccatatcgattaatttgcctgcctcttcattggtcagaaccttccttgcttctctgaccgtcattttgcggcgttttttcttttttggcatcagattgctcagcgcatcctgcatattcatgcccatctgctccatcccggagccttgcagcatgtcaaacatcgacggctgctgctcttccacctctacggagacgtaatggtcttcgagctctcccaatgcgagctgatgcgccatgcgttttcttttttcttcaaggcttgcttcttcctgctgatcggcttcatcatcatttgccgtctgacttcctccgaaaagcatttcaaacggatttttcacacccgcttgttttttctttcccggaacgagaagccgcacgatacgtttgtttgcattttcttcagcctgttctttcacttcgctgattttttcttctttaatgagccgcacggatgtctcaacgaggtctctgaccattgattcgacatctctgcctacatagccgacttctgtaaattttgtcgcttcaatttttataaatggcgcaccggtaagcttggcgatccgtctggcgatctctgttttccccaccccggtcgggcccatcatcaggatgtttttgggaacgatctcgtctctcagtttttcatcaagaagacttctgcgatagcggtttcttaatgccacggcgacagcttttttcgcatcctgctgtcctacaatgtattgatccaaccgatctacgatttgtctcggtgttaacggtttgttttccatgcgcctcaagtcctttctattcaagttcttccaaaatgatctgatcgtttgtgtacacacaaatctcgcctgcgattttcaaagcggcttttgcaatatctttggcggacagattctctccggcataggttttcagcgctcttcctgctgacagggcgtagtttccgccggagccgattgccaaaattccgtcatccggctcaatcacttcacctgttcccgatacgagaagcaaggtatcctggttcatgacaatcagcatggcttccagcttgcgcagcactttatcgctgcgccattctttcgcaagctcaaccgacgcacgttttaaattgccgttgtattcttcaagcttcgcctcaaacatttcaaaaagtgtgaaagcgtctgcaacagatcccgcaaatccggccagaacctttccgttaaacagctttctcacttttctcgcggtatgtttcatgactacagcctgaccgaatgtgacctggccgtctcctgacatagcgcttttcccgttatgctggacggcaaaaatcgttgtcgcatgaaaagatgacatgagaagggcctccttttaattttctttaaaagctctcgggtggtgggacatatatgtgtttctcagcatttccttcgatacatgcgtgtatatctgcgtagaagacagattggaatggcccaaaagctcctggacgcttcttaaatcagccccttcattcagcagatgagtcgcaaacgtgtgccgaagcatatgcgggtgtatatgtaaagtgccggatgctttttttacaagcccgcttaaaatataccggattcctctggcggtcagcgggccgcctctttgattgacaaacagcacatcatgaggctcttttgctttttcaagcaggcactgccttccgctgttgatatacagctccagcgcatcacgggcatatgagccgaacgggatatagcgctgcttcttgcctttcccgtgaacgagcaccgtatccatgaacaggtcaagatcgccgacagtgagcgtacagcactcactgaccctcattccggtcgcataaagaagctcaagcagggcctgatcgcgcatccctgacggctgacttctgtctgagacagcgaatagttcctcaagttctttttcataaagaaacttcggaatccgtttctcttgtttcggcagatgaacaagctgaaacggattctcttcaacaagcttttccctcattaaaaatttatagaagcttctcaaagctgaaattttcttgctgattgttcttcttgacaggcctttttcataagcctctgtcaaaaatattctcacatcatgatatgcagcttctttcattccatttatattttgagcatgcagaaacatcccaaattcttcaatcgaattaacataattcacaatagtatattgtgaataatttttttcaatttgtaaatattcaacgaataactttaaaaaaaagttaacattctcagtcattatgaagacctccctctccgaagggcttttaaatggtatcatataatgcatcgaagttgcaatgaaaagctatatcgttttcgaaatagtttgaatagtctcaattgcgcgtttagcgtattcttcatttcgttcttttttgtttttaatttttacaggcaattcttttaagaggccgaagtttgcattcatcggctggaagttcttctgatttgtcgtcgtaatgtagtgagccatgcttccgatcgccgtctcctgcgggaatgtcacaagatcctgaccgagcacaagtttggcggcattgattcccgctacaagacctgaagcggcagattcaacataaccctctacaccggtcatttggcccgcgaaaaacagatcgttccgctgtttaaattgatatgtcgggttcaaaaggctcggcgagttgataaatgtgtttctgtgcatgacgccgtatctgacgatatcaacattttcaaggccggggatcagtttcagcacttctttttgatctccccattttaaatgtgtctgaaaacctacaatattataaagcgttcccgccgcgtcatcctgtctgagctgaacgactgcataagggcgcttgcctgttttcggatcttccagtccgaccggtttcatcggtccgaacagcatcgttttcttgcctcttttcgccatgacttcaatcggcatgcagccttcaaagaagatttctttctcgaattcttttaaaggaaccgtctcagccgtcgtcaatgcttcatagaaacggtcaaactcttcctctgtcatcgggcagtttaagtatgccgcttctcccttgtcataacgggattttaagtacactttatccatatcaaggctgtctttttcgacaatcggcgccgccgcgtcataaaaatacagatactcttctcccgtgagctctttcagctgctgtgaaagcgattctgatgtaagcggtccggtcgcgataaccgtcgggccttccggaatctctgttacttcctcagtaagaaccgttacgttcggatggtttttcacgagatccgtcacgctttgcgcaaattcatggcggtcaacggcaagcgctccccctgccggaaccgagcatttatcagcagattgaatgattgctgagtcaagcgcccgcatttcttcttttaatacgcctaccgcattggcgagtgtatttgaacggagggagttgctgcataccagttcagcgaatttatcagtatgatgggctgccgtctgcctgacgggccgcatttcgtatagttttacttgaattcctcgttttgcaagctgccatgccgcttcacttccggcaaggcctgctccgattacattaactgtttgctggttcatttcttttcatctcctgttgtttgtcccttccacacaaagaaggtgagcaaggctctgctcaccgctacttctgtggttcttccttataatcgcattcgacgcattggacttgtatgccttttttaagctttttctctacgagcatattttcacatttcgggcattttcgttcaatcggtttgtcccaagatacgaagtcgcattcaggataacggtcacagccgtaaaagacgcgtttcttttttgattttcgttcgacaatatttccttcatggcacttaggacattttacgccgatttgtttaacaatcggttttgtattccggcagtcagggaagttggaacacgccataaatttaccgtatcggcccattttataaaccatccgggagccgcataattcacaatcttcatctgcgtattcaggttcaatttccacttctttcatttcagcttccgcttttttcacgcgtttttcgaaatcggtatagaagctgtcaatgatttgaacccattctgtctcgccatcttcaacatggtcaaggtccctttccattttagccgtgaattcaacgttgatgatttccgggaaaaactccatgataagatccagcacgatctgcccaagctcagtcggcacaaaccgtttattgtctaatcccacgtaaccgcggcgctggatggtgtcaagagtcggcgcatatgtcgaaggacggccgatccccagttcttcaagcgttttaaccaggcgcgcctctgtgtaacgcggaggcggctgagtaaagtgctgctcaggctcaatatcttttgataaaaccgtgtctccctctttaaggtccggaagcatgcggtctttttcttccagctgatcgtctttaccctctacatagactttcatgaagccggcgaatttgactttacttccgtttgcccggaatgtcaatccgttattgctgagatcgacgctcatcgtatcaagtacggcaggcgccatctggcttgcaacaaaacgctcccaaatcagcttgtatagtctgagctggtctcttccaagcaccgcttttaagtcggcaggttttctgagcaccgaagtcgggcggatcgcttcgtgggcatcttgagcgttttcatttttctttgccggtttccgttttcccgctaagtactcttttccgtatgcctgatcaataaaagctgacgcctcttcaacggctgtattggaaatccgcgttgagtccgttctcatatacgtgatgagtccgactgtcccttctttgccgagatcaattccttcatataattgctgagcgatcatcatcgttttcttcgctctgaaattcagcttcctggcagcctcctgctgcagagttgacgttgtaaacggcagagcgggatttcgtttgcgctcttttttcgtcaccttgtcaactgtatacttattgcctttcagctgagcaaggacggcttttacgtcttcttcgctttttaaaggaagctttttgccgtttttcccgaaaaatccggcttcaaacgtctcttttccctttaaaaatgagccggtaatcgtccagtactcttcaggtttaaagtcattgatttccttttcccggtcgatgatcagccggagcgcaacggattgaacacggcccgcactgaggcctttttttacttttttccaaagaatcgggctgattttgtatccgacgagtctgtctagtatgcggcgcgcctgctgcgcatcgacaagatccatgttaatcatgcgcggatgtttaaatgattctttaatggcgtctttcgttatttcattaaagacgacccggcagtccgagctgagatccagatcaaggctgtgtgcgagatgccatgcaatcgcttctccttctctgtcggggtcggccgcgagatagactttttttgctttctttgccgctgtttttaattcttttaaaacagggccttttccgcggatcgtaatatatttcggttcaaagttctgttcgatgtcaactcccatttgacttttcggaagatcccggacatgtcccattgaagctttgactttatatttcttccctaaataacgttcaatcgttttcgcctttgccggcgattccacgatgactagataatcagacattttcatccccctcaagaggtgttctctctcttttcaagtatcaattcattttagagctgcctttttatggctttcaacatttcattctttatgatgaacgtcattttatacatgaaaataatatgcaactttaaatcctcactattattaaatattacaataccgtttgtcaaacgatatttcaaaagggttccgtatactgaacgcatcgggcggtcagctctccgtcaatatcctctgcgcataatacagctttcgccccttcttgaatgagttttataggtcctccggaatatggattaaatatggaacccggaacggcaaatacctctctgccttgatcgagggcctggtaagctgtgattaatgaaccgcttttttcttttccctgcacgaccacaattccttcacttagtccgctgattatgcggtttctcatcggaaagtgccattttttcggctttgtttcaggaggatgttctgagagtaggagatggtgttcagccatgtattctgctaacaggagattttcccggggatagatgtgatggaatccgccggctatcacgccgatcgtaagcccttttgccctgatgctcgccttatgagacaaaccgtctataccggatgcaagcccgcttacaatgacccagcctttttttgagagttcggcggaaagatgcccagccgcttttattccgtcttccgtcggtttccgcgttcctacaatcccgatttttctgcctttttcaagaagcggtgtgttcccttttgcatacaagacagccggcggatcataaatcgctttaagccatgttgggtagcagcttgatgaaatcggaataacagtaatgccttcgcggcggtaatcggacagaacttcatcaagttccggatccttgcgctctatttcccgaaaaattgcttccggggctgttttcccctctgataaaacagttaatggatgcggatccgaaaaaaaagacagagagtgatcagctttccaccattttaatagaagagacggggaaatgatttgattaatactgcagaccattaaacagcgcgatgcttgatccaaatctggcaacctcctcttttttcagcaaaaacaggaacagccgttacggctgcccctgcttcgatcagtgcgttttgcacgtttcaaataagcctttttcttttaacaccttaatcagcgtttcacccattacagaaggggtttccgcgacttcaattccgcaggcgttcatcgttttgactttttcttctgccgtgccttttcctccggagatgatggcgcccgcatggcccatgcgttttcccggaggcgcggttttaccgccgataaagccgacaacaggcttcgtcatgttcgctttcacccactcagccgcttcttcttcagctgtgccgccgatttctccgatcatgatgacggcatgtgtttcaggatcttcattgaacgcttttaacacgtcaataaagttcgtgccgttgaccggatcgccgccgattcctacagcggtagactggcctacgccggcttctgaaagctgatggacggcctcgtatgtcaatgttcctgaacgggatacaacgcctacatgaccctttttatgaatgtatcccggcataatgccgatcttgcattcttcaggtgtaataacacccgggcagttcggccctattaatctcgttttcttgccttccataaagcgcttcactttcaccatgtccaaaaccggaatgtgctcagtgatacaaatgacaagatcaatttccgcgtcaaccgcttccataattgcgtccgccgcaaacggagccggcacgtaaatgactgacgcatcagcgcccgttgtatgaaccgcttctgcgaccgtattgaataccggtacgccttccgcttccgttccgccttttccaggtgttacaccgccaacgatattcgtgccgtattccagcatctgctttgtatgaaataaagcggtagaacctgtaatcccctgtacaataactcttgtatctttattgataaaaacactcattatctggtcccctgcctttcattctttcctaaactaaggatacgattttctgtgcgccgtctgccattgattccgcagatgtgatgtttaagcctgattcattcaggattttctttcctaaatctacgtttgtcccttcaaggcgcacgaccagcggcaatgtcaatccgacttgtctcgtcgcttcaacaacgccctcggcgatgacatcacacttcatgatgcctccgaaaatattaacgaaaattccttttacgttttgatcggaaagaatgattttaaaagcttccgtcactttttctgcggttgcgccgcccccgacatcaaggaagtttgcaggttctccgccgtagtgtttaatgatatccattgtagacattgcaagacccgcgccgtttaccatacagccgatatttccatcaagggaaatgtagcttaaatcgtattttgacgcttcgatttctttcggatcttcttcatctaaatctctgtattccataatgtctttttgtctgtataacgcattgctgtcgaagttcagcttagcatccagcgccatgacgtttccgtcccccgtaacgacgagagggttgatctcggcgatggagcagtccttctcaacaaatgctttatataaaccgagcataaatttagcggctttgccgacaagctctttcgggatgttaattgcgaatgcaatttcccttgcctgatagccctgaaggccgacagccggatcaattaccgcttttttaattttttcaggtgttttttccgctacttcttcaatctccgttccgccttcttcagacgccattaaaacgattcttgaagtagcgcggtcaagtacaagcccgacatagtattcctttttaatatcgcagccttcttcaataagtaagcgttttattacttgtccgtccggacccgtttgatgtgtgacgagcgtcttgcctaacagttcttcggcatactctttcacttcatcttttgtttttgcaatctttaccccaccagctttgccgcggccgccagcatggatttgcgcctttacgacataaaccgagcttgacaggctctctgctttttcaactgcttcctctgctgtaaaagccactttaccttcaggaacagacaccccgtattttctgaggacttcttttccctggtactcatggatattcatttcccatcctcctaacttatgtagcaaaactaaaaatagactgcgctttcattctatataatactggaagaattgtctagggttcaaaacaaaatctttatatccttccaaacattctaacttttattttattgaaaatataaatttaaacggagtccgggaaatgaatggtccttatttttcgtttttcagggttttgtccagtctgtaaacaaatgaaaaaatttcggcaacggtttcatagagcgcctccggtatgtgatcgtcaaccgtcaaatggcgcattaattcgacaagggttctgtcttcctgaatggggaccccagccttctcagcttcttttataatattttccgccacgtgccccctgcctgttgcgacaaccttcggggcttggtctttctgccggtcgtaatgcagggcgacagctcttcttaacggcgtttgctctttcatattttcacatccacttttcttccgccgtctttttctataaactcttccacaagagcgctctggtctttcgggcgccgttttttagacgtgacgcctgacaggctgaagcccgtttcttttacggcttcttttaaagccggtacgagagggtcgatggccgcctgaagctcaaaatcagtctcaaccgtaatggtcattacattttgctgaatcacgcagtccacaacggtttcttgcagtgtttcaagatgcagcaaaaacaggagcctgcaatgtgacggatcgagttttccgtccggcttcttccgtcctttaaagagaactgtgatgtcattctcatacgcggacgctcccagcggaaatgacagcaccatctgcgtaaaagaagggttatgctgctcaataaacagctggccgtttaatttatgaataagcggttccgcctcttgtttaacggattggggcgcttcttgaagcgtccggacggcttggagggccgttttcagcgcttgtttctccggctgcggagatacgcctttttcaagcgctgtaatgaatgataattcatcacgcgtgcccaatccttttttgattttctgcaaaaggcttaatacatcatgtttttccgcatatttcaattcggtgagctgaacggctttttcgaaaacagccgcctcctgttctgtcagatgtgctttttgaagaacaggtgctgttttaaatgttttttcttgagaaatgaaagccttaatgatctccgccgttacttttacggggcggttttcagttttttctgccgatgtcattaatttctctataatctgttttgccgttttttcaggaagtttttgatctgtccgcgcactcggaggagaaggttggcttgagactgcctttccgttttcacgagtctctcggacaaatggtgattgttttgattccgtccgttcttcttcatccatcagcccggtttctgggatcggcatgcgtgcagcctcggcaagcttcttcaagagacgttctgcatgaagatccgtttccgcgtttaatacgtcagaaaccgcctctttgagcacagacagctcttttgccgattgcggtgcctgattgattgcctgaagcagtcctgagaggaggcgccgggtcggaaccggatatttaacggcatgaatggctgacaagacttccggatgtgcgggcagttcccgtttcagcgcaaatacgattgtttccgccgcttttttcaattcggcggccggaagcgattcagcccagcggacgcaggctttgaggctgttttccgtcatcggcagcttctgctgcataaacgtttcggcaatctgcagagacacagggcccggtttgacggaaagagcgtttaacagtctacccgccgcttcctgaacggttttcgggcttccttcgaattggtcgatgacatgaagccggcccgttttttccgccggctgtttgtcataagaaaaccagtaatacgcctgcggacgaagggcggtttcaagttttccctgcatcgtccggccgccgatctggataagagcgctttgatcgtccagcaaacggagaaccttccctaacagcagcctttgagtaccgctgtctttaccgccgtcctgccggtccggagggatttccgccgtcagctgtctgaaagccgcttggatttcgccgctaatgttcatgtcttaagcctcttttctaacaataagattgaacgggagcgaacgtttttcggtgaatagttgtcggtccgtatgcctgaagagcttcaagatgttctttcgttccgtagcctttatttttttcaaagccgtacatggggtaagttttggcgtactcagccatgagacggtcccgcgttacttttgctatgcaggctccggcggcaattgacacgcttttggcatccccttttataactgatgactgcggaatgtcaagcggaagggtcatggcatcaacaagcagataatcaggtgtttccgttaaagcattgacggcttttaccatcgccagtctcgcggcctcataaatgttgatccggtcaatgacgtccgcatggacaatgccgactcctacagccgccgcttcttccgtgatccggctgtaatactcctcgagcttcttttccgacaatttcttcgagtccgtgagaccgagaatctcgcattctgccggcaaaatgacggcgccggcgacaaccggtccggcaagcggccctcttccggcttcgtcaacacccgcaatcaggcggaagccctttttggatgacagtctttcgtatgccgtcatgtccagccattgctctttaagagctttttccttcgcatgctttttcagccattgctctaaaagcgtctgtacgctttttctcgggtctttctcacattgggcaaggaaggggtcgctttcgtccctgatctcttgcaggcgttcttttacgctttttacggttaatgtattcacgttctcttctcccttacattatgtatatcggtattctgcggaaaaaataaagacccgcatcgctgcgcgtctttattctgatggtgcttcaaatgaaagcctgccgaatttttccgtccggatgtcccgaatgataacttccgttgttttatcatagtcaaccattccgccgcccatcaaacagccgcgtttttcaccgatcgcgtcgaaaagagcggcgatatcctcagggatttcctgaagtccgtagcgctccttcaaacggtcgggataatgctcttccagaaagcgcagcccgaaaacagccacatcctgcaggttgataatcgtatctttaatcgccccggtgatcgccaggcgcaagccgacaagctcatcttcaaatttaggccataaaattcccggtgtatcgagcagctctaattccttgcctacctttacccactgctgtgaagtggtaatgccgggcctgtctcccgtcttggcaatgttttttttggccagccggttaatgagcgtagacttgccgacattcggaatgccgatgattaatgcgcggattgctctcggcctaacaccttttgctttcattttatcgaacttatccttcagcagctctttcgaggacggcacgatttgatgcagtccctgcccgttaacggagtttattgaaagagagggaatgccctgttcctgaaagtggtccttccactgggcagtcacagccgcatccgccttatcggctttatttaaaagcataatgcgcggcttattttttaaaatctcctcaatcatcggatttctcgatgacatcgggattctcgcatccaccaattcgtatacgatatcaattaatttcagtttttctgttacttcccgtctcgctttagccatatggcccgggaaccattgaatggtcatgtgacttcgacacctgccttatttaccggaaccggatgttccgatgatctcttatgtattttacgttgcttgttccgcttttacaaatttcatataaaaaaagagcctgttacgggtaacaagctcttttcgttcgttatcattatcgtctgatttctttaatacgagccgcttttccgcgaagttcacgcaggtagtaaagcttagcgcgacgtactttaccgtaacgtacaacttcgattttcgcgatttttggtgtgtgtacagggaatgtacgttcaacgccaacaccgtaagaaatcttacgaactgtgaacgtttcgctgattccaccaccacgacgcttgatcacaacaccttcgaagatctggatacgctcacggttaccctcaacaacttttacgtgtacacgtaaagtgtcaccaggacggaacgcaggaagatcagtgcgaagctgttcttttgtgatatcttgaattagtttttgcatcgttttcaactccttccaacagatgctcttggccacaactgcaaggcacagcggaacatcgttttcaagcttctgaaggataagcctccttaagccacaagtagtatcttatcatatcttcatcacctgcgcaatagaatctattcgttttcccactcggaaatccattttctttgctcatcagtgagaggatagttttcaagaagatccggacgtcttaaaaaggttcttctgattgattctttattgcgccattcttgtattttggcatggttgccggacaaaagggtctcaggcacttttaagcctttataatcggctggcctcgtatagtgaggatgctctaaaagccccgtgctgaaggaatcctccacgtgggatgcttcttttccgaggacgcccggcaaaagcctgacaacgctgtcggcaatcatcatggcagggagctctcccccggtcagcacaaaatccccgatggagatttcatcagtgacaagatgttcccggatccgttcatcatacccttcataatgcccgcaaataaacatgagatgttcctcttccgccagctcctcggctttcttctgcgtataacgctcaccttgcgggcagacgagaataatgcgcggcttggcgtccgtaccggctgtcagcttttcaaccgcatcaaatacgggctgcggctttaacaccatcccggctcccccgccgtacgggtaatcatcaaccgtttggtgtttattatccgaaaaagcccggaaattgatgacgtcaaaacggacagcctctttttcctgtgctttttgcagaatggatgagccgagcaccccttgaaacatttcgggaaacagtgttaaaaagtcgattttcattcgtctattaacccttccattacatgaatcttaattttcttctcatttatattaatatccttcaccacagaagctatatacggaatgagcgcatcttttttgccttttcttgcaaccacccatacgtcattagccccgggcgtcaagatttccttcactgtgccgatcagttccccgtcttctgacacaacctcgcagccgatgatttcatgaaaataaaattcatcttcttcaagctctcccaagtcttcttcaggaactttgatcaccatgtttcttaggtgttcgacttcattgagactcggcatttctttgaattgcagcaggtgaaactgcttgtgaagcctgtgggcgctgaccgttactttgattggctccgcagccccttccgcaaacaaatagagcgtattgccgggcttgtaccgttcttcggcaaagtccgttttagaaatgacccgcacttcgcctttaatgccgtgggtatttacaattttgcctacattaaaccatctgtttgtcatattatcacctcgggcggatttcaattactaccccgtcttttatgacgatggtatttgccgctgttttttcatgccagttatcaccgacgttgattgaaagcagcgcatcgatctccttttccttcacttcgcttccaagcgggagcgactctgtctggcttatttggaaatcaatcattttgattttatcttgtcttttttcaatggcttttttaaaagattccgctacatcgggattctgctgatctttttcatgttttctaagctgaaaatagagctggctgcattctcgttcaagcgtttgctttttttctgcaaaagaggccaaaagcttttccttgctttgctcggtcagaacctgcataacggttaccctgtgaataatctgcataggaccagactccccactcttccaacatatttctgttcatttgccttttttacgtgtaaaaaaaggggaggtgccggccctctccctttttcagtcaaatatttcaaattgaactttcttagaagactgtgcgccagctgcaaaaacgacggttcgaatcgctcttgcagtccggccttgctttccgataatcttaccggtatccgacttattgacagataagcgtagcgcaatcttttgatcagtctcttcctttgtgaccgttatgtcttccggatggtcgacaagcggagccacaatgctgacaatcaaatcttccaagttctgatcagtcattacttgccttgtttagcgttgtggaatttttccataattccttggcttgagaacaagttgcggactgtatcagaaggtttagctcctgtttgaagccatttaagagcaagctcttcattgattttcacttcagccggctttgcaaccgggttgtatgtgccgactgtttcgatgaaacggccgtcacgcggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtaatttaaagccttttttcttcccttttgacatgttggtcatctgcttcatcatttttttcatttcctcaaactgctttaaaagacggttgacttcctgaacggatgttccgcttcctttggcaatccgcttccgccggctggcgttaataatatccggctgttctttttcaagaacagtcattgatttaatgatcgcttccacatgattcagctgtttttcatcgacttggatgttttttaagcctttcattttgcctgctccgggcatcatttgcagcagttcgtcaagaggccccatgtttcggacctggccgagctgctccagaaaatcatccaatgtgaagctcatcgttctcattttctgctcaagctctttggctttgtcttcatcaacggtcgcctgagctttttcaatcagcgtcagcacgtcacccattccgagaatccgggatgccatccgttcaggatggaacgcttcaagagcatcgagcttttctcccattccggcgaatttaatcggcgtttcggtgaccgcgcggatagaaagcgccgcacctccgcgggtatccccgtcaagctttgttaaaatgacgcccgttaaaccgagctggtcattaaagcttttggcgacgtttaccgcatcctgaccggtcattgagtcgacgacaaggaaaatttcctcaggatttgcgacttcctttacgccggagagctcatccatcagttcatgatcgatgtgcagccgtccggcggtatctaaaatcacataatcatgatgctcttccttcgctttttcaatcgcctgtctggcaatttccaccgggctgacctgatcgccaagcgaaaagaccggcatatcaagctgtttccccagtgtttccagctgtttaatcgcggcggggcggtaaatatccgcagccacgagcagcggtttgcggttatgttttttgcgcagcaggttggcaagcttccccgtggttgtcgttttaccggcaccttggagcccgaccatcataataacggtcggcgggcgtttggcggcggcaattttgctttcttcgccgcccatcagctcggtaagctcttcttttacgactttaataacctgctgaccgggtgtcagactctgcatgacgtcctgcccgacagcccgttcacttacttttttcacaaaatcctttacgactttaaagttaacgtcagcctcaagaagcgcaagacggacttcacgcatcatctcttttacgtcttgttcgctgacttttccttttccgcggatttttgaaatcgtcttttgcagtcggtcggctaatccttcaaatgccattgtttgccgcctcctaatctaatttctcaagcgcttcaatcagagccgtcattttttcctcttcctgcaagccggaagcaagctctttcagctttgtaaacatttctttacgctcctgaaactttttaaaaaggagcagtttttcttcatattgttcaagcatcgcttcagtccgtttgatgttatcgtaaacggcttgccttgaaacgtcatactcttcggctatttcaccaagggagaaatcgtccagataataaagcgacatatagctcttttgttttgacgtcagcaacgactgatagaagtcaaacaaatagttcattctcgtcgttttttcgagcgacatttgagctctcccctttgttaagtcaaatccctttacaaaaacttagtttacatggtttcagagcgtgtgtcaagtttttatcttgtcaaagcaggatgctctttttacataataagtgttttcaaaaaaattcatacagaccgtcgttaaaatactcgaattcttgttttgatacacgatagcggcaatagccttcgtaaaaagcattgagacatgattcatttgtgacaaaacgactgatcgctaatgattcatcataacgcggatctcccgccgatattcccgcagcatcgataaacagatagacctctccgtctctcaccagcacattatcagtcgtgcagtcaccgtgaatcattgtctgctgaacaggaacaggcctgtacctgtccaattccttcaaaagctctgcacttccttcagcttgtccttttttgacatattccccggctcgtttgatttgcagatcgagccagtctgtttccggctgtaaaccagagaccatttcggtttcatgcagccgctgcagaaactggccgaaacttttgatcagctttttcttttcagtatcccctttggcttttcttaaagccgaagtcagggtgattccatcctcaaatgacatgatgatatggctggcatgctgttcctgtatcatcccatagtaaataggaacaggcagacgacgagtttccgtcagttgttgtaaaacgaaggcttctctcattaaccattcccgatacttctgttgaaaagaacttttcagcaaaaatgcgtcttgaccggtcactatttttcgaacggttgaagtgcctccctgttcatccagcagcgacatatggtttatcgcgccgatcttactttccaattcagctttcagccatttgtccaacaactgccccctccattccgatctatcaatgcgtataaaaaaacgagtataaaaccgtccattttatactcgttttttattcattaatcttcggctttttcaactaaatccgaaaagagaccgtatacgtaagattctgcatcaaaccgctggagatcgtcaaccttttctccgaggccgaccagtttcacagggatgtgaagctcattgcggatcgccaggacgataccgccttttgcggtgccgtcaagcttcgttaatgcgatacccgtcacattcgtcgctttggagaattctttcgcctgcgccatcgcattctggcctgtcgtcgcgtccagcgcaaggagaacctcatgcggggcctcaggcacttcgcgttcaatgacgcgtttgaccttttcaagctctttcattaagttaactttattctgaaggcggccggccgtatcacaaatcagcacatccgctcctcttgctttagccgcgtgtacggcatcataaataaccgccgcagggtcgcttccggcagcctgcttaatgacaggcacgcctgtacgctccccccacacttcaagctgttcaatcgccccggctctgaaagtgtctccggcagcgagcacaacggatttgccttcattcttcagcttatgggcaagttttccgatcgttgtcgtttttccgacgccgtttaccccgacaagcagaataacgttcaggcgcccgtcctgaatatttaattcagaaatctgttcgtcgccgctgttataaatgtcgacaagcttttcagaaatgacggactgcacttcctgaggatcctgaatgtttttcagcttcacttcttttttgagctcatcaatcagctccatgacggttgtaaaacctacgtcagcgccaatcagcacttcctcaagctcctcgaagaaatcctcgtcgactttccggtagcgggagacgagttcgttcactttatttgagaaggaatttcttgttttttcaagaccatctttaaatttttcagagacggagtctgtctgtttcgtgattttctcttttaattttttaaaaaagctcatctttcaacctctttcctcgttactgaataaattcttttgtttcttccagtttgaccgaaaccattcgggaaacgccggattcctgcatcgtaacaccgtagaggacatccgcttcttccatggtgccttttctgtgggtgatgacgataaactggctgtcgccgctgtatttttttaaatattgcgcaaacctgaatacattggcttcatcaagcgcagcttccacttcatcaaggacgcagaacggcacgggccttactttcagaatagagaataaaagggcaatggcagtcagcgcccgttctccccctgacaaaagatttaagttttgcagttttttgcccggaggctgcgcgataatgtccaccccggaattaagaagatcattcggatcagtcagcttcagttcagcccgtcctcctccgaataaagaacggaacacgtcgttgaattgagaacggatctggataaacgtttcatggaatcgcttcgtcatttcagaatccatttcttcaatgacttgaaacagtgtgtttttcgcttccgtcaggtcatttttctgctctgttaaaaactgataccgttcgtttactctttcaaactcatcgatgctgccgagattgaccgttccgagctcttcaattgaaagcttgatcagtttgacccgttttctcgcctcttcaggctcgagttcaagctgatattgttcttttgccccttcaaaggataagctgtactcctcgcgtaaatactgcaagagattatcaagctcaacttccatccggccgagttttacctcttcatctttcagaatgtccgttttttgcttgtacagacgcttcatctctttcagctcaagctcgttcgtatcaagagcccgctggagcttcacacgctggtcgcgccggctggcgatcaattcgatcgttctcgttttatcgtgaagcttatgatgggctgcttcttcaagctgctcctcaccgcttgtgctggacgtcatctctgaggtcaggaggcttaaatcttcccgtgtttctttcagagcgagctgcgtttcttcaagctcttttttcagccttttgaggttgtcttcctcactcgagcacgcctgttcttttttcgcagcggccactttacattccgtcagttcatgagagagcgtttcttttgttgaggatagggtctgcttttgttttgtcagcctttccatctcttcctcaagctctttcagctggccggatgcctcactcagctgttcttccagagctgatttgcgcgtctctttttcccggctgctttccgtcagtgatgctttctcctggtcgtaaagctccagatgggtattgatgttcttttcagcaacttcgagttcatacagcctgccttttacatcctgctgctttgttctgaaagcctcaccgtcttcacggagaccgctcagcgtatgttcaagctcttgaatggcctgcttcagcgctttgacctctttttcgagcagagctgttttttcttccatttcggcaagccgcgcagtcaccgtctcaagctcgcggcttctgccgagcagagaattgtttttctttttgaccgcgccgcctgtcattgatccgcctggattgacgacatcgccctcaagcgtgacgatgcggtagcggtgcccgagaagcttggccagttcattcgcgccttttaaatcttcagtgatcagcacggtgccgagaaggttttgaatgacattccgatacgccgcatcatatgtgacaagcccgctcgctgtgccgaggaaagacggatgctttgaagccgtctgttcatcacgggtttgaagctggcgcggtttcataactgtaagcggcaggaacgtcgcgcggccgaaggaattctgttttaaatattgaatcgctttccgcgccgcctgctcatcgtctgtgacaacgtgctgcgccgctgcgccgagtgcaatctcaatcgccgtttcatatttttgttcggtcgcaatcagttcgagaacggcgccgcggatgccgccgagctgctctttctgcttcagcacttcttttacgccttggtaaaatcctgaaaaatcgccttgcatcgtttcaagcatatcttttttggatctggcctgctggacgaattgatatgcctgatacagcgctgattctttcttttcatactggcgttttttctgttcatatgctgtctggacttcgcgaaagcggacgacctgattgtgaatatcctcttcaacggcggccaattcctcttcgcacgccgctttgcggactgcaatatcgttacgttcttcaaggtatttttcattgtttgcggtcagtctcgcctgctggaccgcagattgggacatctgatcatctaaaagctgcagctcgttgcgaatcgacgcctggctgtttaacaattcaaagtaatcgctttttaattgttcgattttctcttctacattttcattatgcagactgagagcctgctgcttttctttcacctgggcgtttaaccgcttcacttccgcacgaagtttatcatagacggcagactgtttttcaatgtccgctttcagttcggcttctttgttcgtgtaatgtgtaacggattcctctagctgttcccggttttgcgcggcgttttttttgcgctctttcagcacttctttccggccttccagcttttccagctcttcacttgtcacgagcagcacctgctgcagttcgttgacggattcatcaagcgcgtggattttatctctcgtctcttctatcatcgcttcttttgcggacagagctgatgattccgccaattcttcttgttttgccgtctgcaccttttcttttaaacccgaccatctgctatgcagttgttcgatgtcaaaggcggtaagggcgatttcgacatgctcaagctctttctttttttctaagtagtctttggcgattgatgcctggattttcagcggttcgacctgatcttcaagctcgtggagaatatcttccaccctgtttaagttatcctgcgtctcaaacagtttgttttccgcttttttctttcgtgttttatatttcagcacgccggccgcttcttcaaaaatactgcggcggtcttccgctttgctgctgagaatctcttcgactttcccctggctgataatggagaacgcttcttttccgagcccggagtccataaataagtcaatgatgtctttcaggcggcactgctgattgttgatgagaaattcactttctccggaacggtacacccgcctcgtcacgctgacttcgtgataatcgatcgggagaaaatgatcttcattatcaagcgttaacgtgacttcggcaaggttcagccgcttgcgcgaatcacttcccgcaaaaatgatatcttccatttttccgccccgaagcgagcgggctgattgttcgccgagcacccagcggatggcttcggtaatgttgctctttccgctgccgttcggaccgacaacggccgtgacgccttttacaaagtcaacggatatccgttctgcaaatgatttaaatcctataacgtctaaacgtttgaggaacatcccagatcctccttatcgtataagtatctcaatattatcataatcacccgcttatatcaggcgcagacatactgaaatcccctagggatacagggggattttattgtttcgtatgatgtttttgcaattttgcaagagcttcctgtgccgcatgctgctcggcttcttttttggaacgtccgttcccgataccgagcgcctcacctttaagagagacgagcgcctcgaattcccggttgtgggcaggccctttttcattgagaattttgtactcaagcgatccttttccgtcccgctgtacaaattcttgaagctggcttttgaaatccatcacatgagaaaaagcaccatcgtttattttagggaacacgtactctttcaggaattgctgaaccggctcaaggccctgatccagatacagtgcgccgataaacgcttcaaacacatccgctaaaagcgcaggacgctttctgccgcccgtcatttcttctccttttcccaagagaacaagatcgccgaatgacaattcgtgggcaagtgagacgagtgacggctcgcatacgatagcggctctcagcttcgtcaaatctccttcactcatggccggatatttggcaaataagaattgggagatcgtcagttccaaaacagcgtcacctaaaaattcaagcctttcgttgtcttcatacggctttttccgatgctcattcacataagatgaatgtgtaaatgcttgatacaaaagtttctcgttttgaaaatgaaccgaaatccgttcttggaactctttaaattgctctatttttttatagaacttttttttatctttaaaatgtgagtgttttgacatagtaacctccataggcacatcaggttcaccgcgctccccgccgtaaacggaatcagcagcgcgtacagcgtcagacgccggtaaccgaacgattaaagggctaaagccccgctgtcaggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtcagcttcatcaacgccaaggcggtctacgatgattttcgttacacgctctaatgtatctgccatagcaattcacctcccctcaagtattatagaggattcgtttttaaaaaactagagaaactaggatgaaattttaaaaacaaatctttacatcaccattccgccgtcaatatgaagggtttggcccgtcatataacgcgatccttcagaagcaaggaacgtaacaacgctgctgatatcggaaggatcaccgaaacgcgcgagcggaatctgcttcagcatttcatcttggacttctttagaaagcttgtccgtcatatccgtggaaataaagcccggagcaatggcattgaccgtaatatttcggctcgcaagctctttggctgatgacttcgttaagccgattacaccggcttttgccgccacatagtttgcctggccggggtttccgctgacgccgacgattgatgatacgttgataatccggccggagcgctgtttcatcatctgtcttgtaacggctttcgtgcagttgaatacaccttttaagttaatgttaatgacatcatcccattcattttctttcattctcatcagaagattgtcttttgtgatccccgcattgttcacgagaatgtcgattgaagaaaatgcagcgacagcctctttcatcatgttttgtacttcttcggaatttgatacatcggcttttacggcgatcgcgtttcggcccaaagatttgatctcatctacgacttcgttcgctttcgcttcattcccggagtagttgactactacattacagccgtttttcgcaagatcaagcgcgatcgcccgaccgattccgcgggacgctcccgttaccactgctgttttttcattaagcatcctgattctcctccttcagcgtttgaatcgccagttcgatggtttcatggtcagaaaccgagattgttttaaggcggcggttcacttttttcacaaggcctgaaagcacttttccgggcccgatttcaacaaacgtcgtgacgccttcgtcaatcagtttgttaatggtttcttcaaagcgaacaggcgaatacagctgttcgatcagttttttcttgatatcgtctttttccgtcataacgtcagccgaaacgtttgaaatcacgggaacagccgcattttttaactcacaggcgctgagcacctcctcgagtttttgcgctgccggcttcattaattcagaatggaacggtccgcttacttctaatgggatcgcccgttttgctccgttgtttttcgcttcctctgaagccagctccacgccttttgccgttccggaaatgacgatctggccggggcagttcagatttgcaagctgtacgagatgaccgttttccgtcacttgatccgtcacctttttcaaggactccgcatccattccgagaatcgctgccatggcgccttctccggccggcacggcttcattcatgaattctccccgttttcttaccgtgtaaacggcatctttaaatgtcatcgctcccgccgcaacaagcgccgaatattctccgaggctgtggccggcggtgaaatcaggggtgatgccggattctttaaacttttccaatacggcgatgctcgttgtcaacagcgcaggctgcgcattgtatgtaagggtcaattcttcggcgtcaccttcaaaaatgagcgagctcagctttgtttcaagcgtttcatccgcttcatcaaaaatacgttttgacgcttcttcgcgttcgtacaggtcttttcccatgccgatatattgtgatccctgtccgggaaataaaaatgcaatcttactcatgatgcggtaacctccagactactcatctgttttttcttcttttacttcttcttctataaatgcggccacgttttggctgaccatttctctcgcctggcgcagcgcatggtaaacagcgcgtgcgtcagaagagccgtgcgctttaatgacgggcgctttcaaaccgaaaagactcgccccgccgtactcagaatagtccattttcagtttcatttccatcagcttcggctttagcacgcccgctgcaagcttagaaacaaaacttgaagtcagtgtatctttcagcattttgaaaatcgataacgctgaaccttccaatgttttcaacgtgacgttgcccgtaaagccgtctgtgacgatgacgtcagcagcgccttcgagcaagtctctcgcctcaacgtttccgacaaaattcacgtttgtttcttttaataattcaaacgtcttttttgtcaggtcgtttcctttcttttcttccgtgccgacatttaacaatccgacgcggggcgagctgattccgagaacctgccgggcataaacagatcccataattccgtactggacgagatgctccggtttggcatcgacattggctcccacgtccaaaagaaggaaaccgtcgcctgaaacggtcggaagcgtcggcgcaagcgcaggccggtcgattcctttaattctgccgacgataaacagtcccgctgtcatgagtgcgcccgtattccccgctgagatgcaggcgtccgctctgttttcagccacttcctgcgccatcagcaccatagaagagtttttctttctgcgtacggcgcggaccggttcatccgtcggttcaatcacttcatcggcgtgcaacacagtgatgcggtctgatgttgttggcaagtgtgattctatcgttgtcttgtcaccgaccagcgtaatatgaagatcgtcaaatgcctcaatactcttcattactccgtcaataacagctttgggtgcgttgtcgcctcccattgcatctacagctattctcatgcatgctccacctttatgattgttttgaacggtacatgtcaaagctgccggagaacacgacttcttctcccacatagctgttgacttcaactaccgttctgcctttttctttttcgactgccgtcactttggctttcgcaacgacgcgctcgccttctttcacctgtcttgtaaagcggatatttgcgcttgcggtcagcgccagctcatcatcaatgacggctacggcgagtgagttcgcctgcgcaaacaaatgatgcccccgcgcaatttgattgcggctgaagacatgttcgcgtcttacttctaatatggaaatggcctggccgtcaagctccagatcaatgatttcaccgatcacttcgtctaaagacaatgatttcacttcatcatcaagcgtttgttctgccacgtttttaattctttccctcagctccggtattgagagctctaagcggtctaaacggatcgtctgaatgctgacgccgaatttccccgctaattcttcatctgtgatgaagggtgtcgatttgatcgtctgctgcaataatttttggcgttctttcttgcttcttctcatctgtaaacaccatccggacaattaagactaggtactaatagtagtatataatctcatagattggaatgcaatgattgttttttgaaagccgccgaattttacagaatcagcttaatttctccccttctaggacgccgcttgaaagtaattgaccgcgcagcatgcggtattcgtcatctttccaaaaagcctctgaagacaccagattggccgcatcctggcgggccgtttccaaagctctgtagtcatgaaccatatccgccaccttgaactcgggcataccgctctgtttttttccgaagaaatcaccggggccgcgcagttcaaggtccttttcagacagctcgaagccgtcgtttgtctctgacatgattctcatccgttccttcccggtttcggatttcggatcggccatcaagatgcagaaagattggtggtctccccgcccgacccggccgcggagctgatggagctgagataatccgaaacggtcggcgtcatagatgaccataatcgtcgcattcggcacgttcaccccgacttctacgacggttgttgacacaagtacctgacattgattggcgctgaattctctcatcacttgatctttttcatcagaatggagcttcccgtgcatcaggccgacattccatttaccgcggtaaacgtcagacagcatgttatatacgtcaatcgcattctgtacatccagtttatccgactcttcaatgagcgggcagataatataggcttgccttccctgcttcagctctttttctataaaagccaaaatccgctccagcatgtcgtgtttcacccaatacgtttcgatttgttttcgccccgcgggcatttcatctatcacggaaacatccatttctccgaagacggtaatggccaacgttctcggtatcggggtggctgtcataaacagcacatccggatcttgacctttattcttgagttttttgcgctgttcgaccccgaaccggtgctgctcgtccgtaataacaagactcagcgctttgaattccacttcatcctggattaaagcatgggtccctactaaaatatcaatctctccgagagcaagccgctccaaaagctccctgcgccgctttccttttacagaactcgtcaaaagcgcgatatttacatcttcatttgcaaacaacgatacgagagaatctgcatgctgttcggccagaatttcagtcggcaccattaatgccccctgatgccccgacagaatcgcagcgtacaaagcgatggcggcgacggccgttttccctgaaccgacatcaccttgcagcagacggttcattcggtaaggggatgtcatatcagcggtaatttcccgaagcacgcgcgtctgtgcggtcgtgagcgaaaacggcaggctgtctgtgaaagcggtgagcttttcagcaggaaacacatggctgatgccttttgactgttccctttccgctttacggaacgcctgcattttcagctgaaataataagaattcctcataaacaaaccgtcgtcttgcctgctgtaacgattccctcgtttcaggctgatgcatcgtctgcagggcatgtttgtaatcaggcagcttatagcggattctcaatttttcaggaagcggatcggccgcactgtccaaatgatgctgcagcgcttccttaataaaccgtctcatcatttttacggtgacgttttctttaacggaataaacaggctcaatgcttttatcttcttgatgaggaccgttttttaattcctgcacggaaacggtctgtctgtgtttatcccatttcccggatatcgtgacgacagaacctaacgtcagtttcttttttaagtagggacggttaaagcagaccgcggtaattaaataattgccgacaagcaccctgaatgtcagcctgtttcgttttttgccgtaataggtaagagaaggttctgaatgaaccttcccttctaccgtcactctttcttcatgttttacttcttctaaatccctcagctcatagtcgtcataacggtaagggaaataattcagaagatcagaaatgtcatagataccaagttcgtgcaatgttttttctgtttccggcccaatgcccttaatttccgctatactagtttgctgatggtgtgtcacttgatttcagcgctcctccgaaaatttttttctctaattctcttcccgtcggtgtcgcagctaaaccgccttgtcccgtttcacgcagtgctgtcggcattgtctggccgattttgtacatcgcgtcaatcacctcatcgcaaggaatgcggcttgtaatcccggccagcgccatatccgccgcgatcatcgcgttggatgctcccattgcgtttcgtttgacacacggcacttctaccaatccggcgaccgggtcacatacgagaccgagcatatttttcagtgtaatcgccattgcttccgctgattgctgaggcgttccgcccgccatttccacaatcgcggccgctgccatgcctgatgctgacccgacttccgcctgacagcctcctgccgctcctgaaatactcgcattatttgctacgacaaaaccgaacgcgccggctgtaaacagaaaacggatcatttgttctgtcgtagggttcagcttatgctttacggcgaataacgttcccggcacaaccccggcagagccggcggtcggtgtagcgcagatcgttcccatcgccgcattgacttcatttgtcgccacagctttagaaacggcgtctaaaatcagattgcccgaaaggcttcttcccgattggatgtatgcctgaagtttcacggcatctccgcctgttaaaccggtctgactcgtgacgcccttcagccctttttcaacagctgcttccatgacggagagattgcgctccattccttgaaagatttcttctcgtgttttttgcgtcacttccatctcttgggtgatcatcacttccgaaatcggaatttgtttttcttgagtgatttctattaattcttttacattacgaaacatgtcattttcctcctgactttttagtcagctatcttagtaacctgtataatattaggaagtgttgaaagctcgtcaagcacttcttcttcaatattctgatcgacctcaatcgtcatcagcgcaagctggccgacgtccttacgcgccacttccatatgtccgacgttgatggagaatttcgcaagcacattggcaacgcctgcaatcgtgccgaatttatcattgtgaacgactaaaatagccgggtggtttccggaaagtcgcagctcaaagccgttaagctccgtgatttctatttttccgccgccgatggaaataccggtaagggcaagctctccctcatcatcagaaatgacgatacgcgccgtattcggatgaacgggcacggcatcctctgtacggaactctacatatatgcccttctcttccgcaatttgaatcgctgttttaatccgttcatcaaatgtatcaaaatcaagcaggccgccgataatcgcgacatcagtgccgtgacccttatacgtttctgcaaatgatccgtaaaaagacacaacgatccggcggggctcacgcctgaataagcttctggccactctgccgatccgggcggcgcctgcggtatgtgaactggacggaccgatcatgaccgggccgataatatcaaaaacgcttctatacttcatgctggtttgctcctccttaacatcacttcattcagcgcttttctttagactaattgaacatttctcaattggcaagcaggcacactgccgcactgccgcaggtaaataaaggcataagaatagaagggcctgataagcccttctattctgccgcaaatatatatggatacagaggctgtctgccgttatggatttcaacctcgatatcttcacagacgctagcaatatactcagcgagtttctcagcttcttcttccggcgcgtcctctccgtacaggatggtgacgatttcatcttcttccccgatcatttcatccagcagcaatttcgccgcacttatccgatcttcggcgctgccgataattgaactgtttaaaatgccgataaaatcaccttttttaatttctttgccgtcaatatgggtgtctctgactgaatatgtcacctgtccgcttttcacattccggatggcctcaagcatattggcttcatttacatcagccggctggtcagggttaaacgcaagcagggcggtcatgccttgagggaccgtttttgccggaatgacaatgacattttcttcagctacgctcgccgcctgattggcagccatcacaatattggaattgttcggaagaatgaaaaccgtctccgcattgacagactgaacggcttcaacaatatcttccgtgctcggattcattgtctggccgccttcgattacgtgtgaagcgccgatgctcgtaaacaattcagaaatgccctctcccattgccacagtcacgatgccaaaaggcttgcgggcttctttcataacgccggccggctttttttcatcatgttcttggctgatgattgaagtatgctgttccctcatgttttcaattttaattttaatcagatcgccgtaacgctgtgcgagattgagtacgttcccaggttcttcggcatgaatatgaactttcgccagcgtatcatcagccacgaccagcaatgaatcgccgaaacggctcagttcgtttctgaacgcctcttccttgaacgtccgtttatcttgatccagcctcaccattacttccgtacaaaatccgaattcaatgtcttctgtactcagcatgctctgcgcgcttttatgatgctcggcattcaccatatcatcgagtgccggaagaaccgcttttttcggtacggcctctccttttaaagcagccaaaaagccttcatatacacaaagcagaccttttccgccgctgtcaacgacaccgacgtcctttaaaacaggaagcagatccggcgtgcggttgagcgacgcttccgcttcttcaataacggcctccatgactgaaataatatcggtttcttctttggccgaggcgaccgcttttttagccgcatccttggccacggttaaaatcgttccttcaaccggtttcataaccgccttatatgccatatccactcccgcttggagtgctgcggcaaactcttgggcatcaatttggtttttgttttcaatgctctttgtgaaacctctgaacaattgggacaagatcacccctgagtttcctctcgctcccataagcaggccttttgacagggcgatgccgactttgccgatgtcgggtgagtcaatgtgctctacctctcttgcaccggatgacatcgataaattcatatttgttccggtatcgccgtcaggcacgggaaacacgttcagcgcatccaccgcggatgcgttttgagacaatgtctcagccccgccagaatcattgccgcaaaagctctcccatctaagtttcgtctagacaatactcatcctcctcactacgggttcgttactcgtacgccttggacataaatatttacagaatcaactgcaagtccgattgtttgatttactgtgtattttaccttcgtctgaacattgtgggctacttcggatattttagtgccgtagctgacaataatgtacatgtcgatatgtatttgttcggcttcctgacggacatgtacgccttttgcgaagttctctctccggaggatttcagacaaaccgtctttaatctggttttttgaggccatccccactattccgtaacagtcaatggcagcgcctccggcaaccattgcgatgacttcgttggatatatcaatctgtccgtattttgtcttcatttcaatggacacacaggttcctccttcaggtgcatagagttatcattattctactatatgtatcccattatgaaaagaaaagatacagacagcggccttcagcgcggaaatgtgattggttttacatgtcaagtgatttttcttgaaagtaagggaaacaatagttgcaaacggtttttagctgtggtaaattatttaaagtattgtataacgaaagcatctgagacactatgtttaaaaagatgtttcgcgcagttaggagggaaacaaatggcacgtaaatgttttattacaggtaaaaaaacaaaagccggaaacaaccgttctcacgcaatgaacgcttctaagcgtacttggggcgccaaccttcaaaaggtccgcatcctcgttgacggcaaacctaaaaaagtgtatgtatctgcccgggctttaaaatccggtaaagttgagcgtgtataagcaaaaatgaacgcctgcccttttatgcggcaggcgttttttatgcgttcaaagagggcgatttcagcttcttgggcttactcttttctaaatgagcccagcatcgcccggacaattcctcctaaaaacttcggcaatttaatggtataaaatttcattttgtcccctcctataagtcccgtatccgctgcgttcatcactttaggattcatggttttttccgcatatggcagaagccgcttttctaatccgcgctccttaccattattaatatgccttttgcaaacgaaaaagtacctcgtgaatgaatgagttcgttactaatacatagtgtggaacccagaggaatatgacaattatcaaggggatatttaaaaccgtcgagtgtcaggccgtctgccgcttccgtaaacggaatgaaagaaatatagcgtctgcgcgctttttcttcaattgtataacggccgggcccgaacatctgaatgtcattctgccggtcgatcagcttgacatcggtatgcttatgtaaggctttatacagcagctggatgttccctaaaaagtgatcggctcttccgcccgtcacaccgaatacccgaatgttttccggttctttttgtaaagcccagtcaagggcgagttcaagatcggtataatctttttccgcctgatacacatggagggccggcgccgctttttgaatctgcatgagctcctcttccgtaatgctgtcaaaatcaccgaaagcttcctgcggaatgattccggcctccaaaagagcaaccgtccctttatcaactccgacccacgtcgtatctccgtctgtgtattcggatagatcgggaataagctcccgcgggccgcccgcaacgatattgattgtcttcatatgctatcctctctcttagacgcgaaaagagccggcggctttcaccgggctctttttcagcatgtttatgatgcgtttcggatgtcagcgatggcttttttccgatccggctgattatatacggcagacccggcaacaagcagattggcgcccgcttcagcgcataaaggggctgtttctttattaacgcctccgtccacctcgattaaaagctcagacaggcctttctcctcagccagctgtttgacctgacggattttcggcagaaccgaatgaatgaagcgctgtccgccaaaaccggggttaaccgtcattaacagcacaaggtcaagctcctcgatcacatgttcaatcatttggacgggcgtatgcggattaagcacaactcccgcttttaccccctgctcttttatcaattgaatggtccggtgaagatgcggacacgcttcagcgtgaacggaaaggatgtccgcaccggcttttgcgaatgccgggatgtagcggtccgggttttcaatcataagatggacatccagcggcagatcagtcaccggacggacggcttcaacgataagcggcccgattgtaatgttagggacgaaatggccatccatgacatcaatatggatatagtccgcccctcctttttccacgtctttaatttcctcgcccagtgaagcaaaatcggcggaaagaattgatggcgcaaccttaatcatattaatacctcggctttctctcttttatttcctgcataaattctttgtaatgctcgtagcggtacggctgaatctctccttcttccaccgcttgctttaccgcgcatttcggctccttaagatgcagacagcctctgaatttgcaggaggcgcttatttctctgatctcagggaacgtgctgcccagctcttcttcctcaatgccggtaaattcaagcgaactgaaccccggagtatccgcaaccagaccgcctgatgtatgaatgagctccacatggcgcgtcgtatgttttccgcgtcccaaatgcgcggaaatctcgtttgttttcagctcaagctccgggctgatcgcatttaaaagcgaagattttccgactccggactgaccggcaaacaccgtcgttttgtcctcgaagtgtttcacaatgcctgttaagccgctgttttcttttgatgacgtcacatatacgtcataaccgatcgcctgatagtctttcacgtaagaaagtatcgcctctttcgattccccgtctgcagctaagtccattttggttatgcagatgatcgggtgaatgccgttggcttccacaaggacgagaaaacggtccaataaagacgtgctgaacgccggctgaacggcagaaaagacgagaacggcctgatcgacatttgaaatcggcggcctgatgagctcatttgttcgttctttgatttccagcaggtagccttctttatcattttcagcctgataaacggcataatcgccgaccaggggcgttattttattttttctgaaaatgccccggcctctgcattgaatgatcttgtcctgtgattcatccaagacataatagaatccgcttaacgcttttataattttgccctcaggcatagggtccctccttatcagtcattatctttcgggtattcaatcgttttgtagctgacgactttatgatcgaccatcacttgataataccccttctgtccctgatcaatcttcagttcaattgttttttcggtcggctcttttattttaaatgagtcatacgtatcagagatgctgtggtccttatcatcgatggcgatttgcacttcaagctcttccccttcatgttcgggttcgtaaggaatgctgattttttcttttaccgttttcgccggtttttcttcaggtccgagcgagaacgtcacttcaacattacttcccggcttaaccgcagtgccggctgacggctcttgtttcatgacttgtccttccggcacgtcatctgaatgggcttgtttttcaacaagctgcaggccgttatcttcaagataccctgaagccgcttctttgctgtaagtctttaagtccctcagcgtaacgtccgccgggccgaggctgaccgttagattgacttcatcatcgcttgcgaccatatcggtgccggctgacgggtcctgatcaattacggtgccggcctcgctgtcatcgttttcttctttgacattgacatgtttgaaacctttttccttcagcgctttttttgcgtcgccgatctgccgtcctttcacgtcgatcagctgggttttcggttttccgatgcttttgtacagttttacagaagagccttctttaacggtagaccccgcttttgggtccgttttgaccattaattcctcttctattttttcatcttcaatatccgttatatcaggatcagcccggagcccgttcttttcaagcagggcttccgctttttcgtacttcatgccccgtacgtcggggacgcttacatctttaggcataaataaagacgggaacacggtgaccgcaagaacagccgccataataaaaatgaaacagacggccagcaaaacccacggccatttccgttttttctttttggctggctgctgttccttatcatccgtctcccccggcgtttccgcctgagacgcggcttttgggccgtcagtaataacgggaatggcttttgtcatttcctcatcatcctgcacggaaaatttttgttcattcagcctgccggcgtcaaaagccgttctgatgtccgcctccatgtcctcggcgctttcatagcggtgaaacgggtctttggcggttgcctttaaaataatgttttcaacgctctgcggaatggaagggttccactttctggcggaaggcgtttctgtttgcaggtgctttagcgctatgctgacggctgattctccgtcaaaagggattttgcctgttaaaagctcaaacagcacgatgccgagcgcgtaaatatctgattttttcgttgccagaccgcctctcgcctgctccggagacaaataatgaaccgagcccagcacagaattcgtatgtgtgattgtcgtagacgtaagcgctgtggcgatgccgaaatccgtcaccttgatatgccctaaatgatctatcaatatattgtgcggtttaatatcccggtgcacgatatggttttgatgggcatgggcgatggccgagacgatctgctccataacggacagcgcttctttcggatgaagcggtccgtgtgcgtttatgtattcctttaatgtcatgccttccacatattccatgacaatgtaataaatatcgccttcctccccgatatcgtaaatactgacgatattcggatgatcgaggcttgatgccgactgtgcttctcttctgaaacgcctgataaaatcaatgtcattcacaaagtcaaaccgcagaattttaattgcgacttcacgttcgagaatgatgtcctcagctaaaaaaacgtttgccattccgccgccgccaatgggccggaggatatgataacgcccgctgatccgcttgccggttagcacttgtcttcaccctcttttgcatctgcggaaaactcaatcaacacagccgtgatgttatcttcgccgccgttttgatttgctttgctgatgagaaggtctactttttcctgatgatcagattcggcttgaagcatttgtttgatctcgtgatcttctattttatttgacagtccgtcagagcataaaagcagctgatcgccgtcagacagttcaaaagaacgggcgtcggggctgatggtttcatctgtccccagcgctctcgtcaatacatttttccgcggatggtgctcggcgtcctctttcgaaatctcccccgtcttgaccagctcattcacaagcgaatggtcctcagtcagctgagtgaattccccctcttgaagcaggtagcaccggctgtcaccaatatgagccacagtgacaaacttccccgtgaataaggcgcagacaatggtggtgcccattccccggcattcttcattggctttagcgtggtcatgcactttgacattcgcctcatgaatccggtctttcagccaatcctcgcaagcggacggcagagaaggaaccgtttcggtccggttccactgctcttccatcgccgcaaccgccatcctgctcgctacatctccggcaagatgaccgcccatgccgtcggcgacaaccgcaagcaccgcgtcttcttttgtgaaaatgcccgccgcatcttcattatgccggcggactttacctgtatctgttttcaaggctgtaatcaacctcttcacctcgtctcgtcttgacgctccttcgcgcgaagctgaccgcaggccgcgtcaatgtcatggccttgctctcttctgatcgtgacatttacaccgcgggattttaacgttttttcgaatgcgaaaatctgatctctcggtgtgcggacgtaatcccgttcaggcacatagtttaccggaattaaattgacatggcatttcacgtcttttaacagttctgcaagctcttctgcatgttcgacctgatcatttacgccgccgaacagcccgtattcaaagctgatccgtctgcctgttttctcgatgtaatatttgacggcctccataaggtcaggaagcttataggctttgttaatcggcatcagacggcttctgatttccgtattcggagcatgcagagaaatcgcgaaattgatctgcattttttgatcggcgaaatcgtaaatcttcggaatgattccgctggtggaaactgtgatatgacgcgctccgatgttcagccctttatcgtggttaatgatttttaagaaagcgagcatttcattgaaattatcaaacggctctccgattcccatgatgacgactgagctgacgcgttcatccgtttcatcaagcgccttttgcactttcacgacttgagcgacgatttctcccgcttcaagattccgtttcagaccgccgagcgttgacgcgcaaaatgtgcagccgatccggcagccgacctgtgtcgttacacatacagaattaccatactcgtgtctcattaaaaccgtttcaatcgtataaccgtcatgaagctcaaataaaaatttcatcgtgccgtcttgagatgtctgttttacagccgttttcagcgttgtcagcacaaaattgctctcgagtttttcacgcaggctttttgagaggttcgtcatttcatcaaatgaagaaacccgcttttcatagagccattcaaaaatctgtgctgcgcggaacggcttttcgccattctcggtcagccattgtttgatttcatctaattcaaaagagtaaatggacggctgctcagtccgcagctctttccgtacgcttgtcttttttaattgtgtcatttttatcccttctttctcatgctgctaataaagaaaccgtctgttccgaaataatgcggaagaatttgaaggcttccatcctgaacaaagggtctcgccttttcaggcagccgcttttcaagagacaaatcgggttcaaactcagggtgttcttgtataaacgcatgcataacttcttcattttctgtccgatccattgtacacgtactgtatacgagtgtgccacctttttttactaatggggcgatttcccttaaaatgccgagctggatttctgacagccgtctgctgtcctccggcgtcttcgtatatttcatatcgggttttcttctgatgacgccgaaacctgagcaaggggcatcaacgagaatacggtcaaaccgttctgcgccaaaggcctctcccgcttttcgcgcatccatcgtttgcgcgtcgatgatcgtaagaccgagccgttctgcgccctctttaatcagcttcactttatgacggtgaagatcaagcgatgtgaggctcccctcgttctccatcagttccgcaatgtgagccgactttccgcccggtgcggcgcatgcatctaaaacggtttcgcccggcttcgggtccagcgcccgggcgacaagcattgagctttcatcctgtatggatacccggccgttttggaaaaatgccgtgttcgcgatgcttcctttcaaaagcttaatcgcatcaggagaaaggtctccggcttccgcttccagaccggcattctccatctcattcagcaccgtttccctgtcgctctttatgtgattgacacggagcgtctgcttcggcggaatgagatgaatccggcagattttttcagccgcctcaaagccgtacgcctcgacccactcttttacgagccattcgggatggcttgtctctgtagaaagacggagaaccgggtcttcaatttcagcaaatgacggcgccccctcacgctgcagggagcggagaatgccgttgacaaaggacgcaatgcccttatgcccgcgttttttggcgatttcaaccgcttcatggatggcggcgcgatccggaattttttctaaatactccatttgatacgcggacagacgaagcagctgaatcacccacggcttcaccttattcggcttgcggataaaaggcttcagcatatagtctaaggcgattttattttgcagcgttccgtagacaagctctgtcagcagtcctctgtcctgatcgctgagcgtgttcgttttgataaccgatgtaagaagcaggttgctgtatgcctgattttgctcaagcttctcaagcgcttcaagggcgagctcccggacattaattttcttcatttgctgctcctaacacgtcaccgggctgcacatttttgcctcttacaaaatcttcgcccttcatccgttttttccccgccggctgcagctcagtgattaaaagggcggtgctgtttcctgatgcgacgacaatgccgttttgctccgtgcggatgactgttccgggcgcagcatcagtttttgccgcaactttttcagaagcccatactttaatagtttgaccgttcaaagttgtataggcgacaggccaagggtttaaacctctgatctggttgtagatctcttctccgggctttgcccaatcaatccgctcctgctcacgcttaatgttaggcgcgtaagtcgcttttgattcgtcctgtttgatcggtttaatatttccggagatgacgttcgggacggtctctgacaaaagctttgcccccgctatgcttaatttgtcgtgcagcgtgccgacgttatccgtttcatgaatttccacttcgattttagaaatcatatcgcccgcatcaagcttttcaaccatatacatgatcgtcacgcctgttttcttcttgccttggagaatcgaataatgtatcggcgctccgcctcttaattcaggcaatagtgacgcgtgtacgttgatacagccgtatttcggaccgtccagcagctgcttgggcaggatctgtccgaatgccgccgtaacaatcaggtccggcttcaggcttagcactttttctatttcttcttcgagccttactttttcgggctgaagcacgggaatgccgtgacgttcagcttcagcctttacaggagggggcgtcatgattttttttctgcctttcgggcggtcaggctgcgtaacgacaccaaccacttcatatccgtcttcaataagcgtgcgcaggacgggaactgaaaagtcgggcgttcccataaaaacgatccttgtcatccaatcatccttccatttctgccagttcttcttcagtgtagtaagccgtaatttttgatgtgaataaaatgccgtctaaatgatccatttcatgctgaacggctctggccaaaaaaccctccgcttctaaaataaacggttttcctttacggtcgtgggcttttacctttacgtaatccgggcgggtgacatcaccgaaaaccccgggaaaacttaagcagccctcgactccggtctgttcaccgctcttttcaagaataaccggatttacaaggtcgatccggccgctttcttcaccgatgtccacgacggccgctctttttaaaatgccgatttgcggcgcggcgagaccgacgccatccatttcgagcatcgtatcgtacatatcgtcaagcagtttttttaattttttatcaaacactgtcacttcatcggcgggtgtttccagaacctccgccgggtgtgtgacgattttttttacagccaaaattttgccctccaaaaactaatgttacatcagcatgtacggattcatatcaattgaaatcattacatgcttttgcgcaatgtcgcgtttatagtgctccagtatctttttcaactgaatctgcaactcgttttcctgtctgtattttatcacgcattgatagcgatatctatctttgatcctggcaatcggggaagccgccggcccgagaattttcgtatcaggcccgcatcccgctcttaaatagtttgtaatcttttctgcggtgaccgcggcttttgccgcttcttcatgagaaacggtcaccagcgccacgtaataatacggcgggtatgactgggcccgtctgtgcgccatttcctgctgaaaaaaagtttcatagtcgtgcgttttcgtcagctgaatgctgtaatgagacggtgtatacgtttgaatgaccaccgttcccggcttttcatgccgcccggcccgtccgcttacctgtgtcagcagctggaatgtcttctccgcggccctgaaatctgggatgtgaagcgtcgtatcggcgcttaatactccgacaagcgtcacgttcggaaaatcaagcccttttgcgatcatctgcgtaccgagcaggatatccgccttcccttcaccgaacgctgacaacagtttttcatgggcgccttttcttgaagtggtgtccacatccatcctgatcacgcgcgcctgaggcagcactttggtaagctcctcctccacacgctgtgttcccgtgccgaaaaagcggatatgttcgcttccgcattccgggcatgttcccgggacaggttcctcatggccgcagtaatggcatttcagcctttgtccgtagcggtgataagtcatggaaatgtcgcaatgcggacattgcggcacataaccgcagtcccggcacatcacaaacgaggaatacccccgtttattcagaaaaaggacggcctgctctttttttgcaagcttctcttccagctgttccatcagctctcttgagaacattgatctgttgccgtttctcagttcttctctcatatcaacgagagaaacgtcaggcatgagctggcggtttacgcgatgttttaacggaagcagctcataaacgccttttttcgcccgcgcaaatgactccaatgtcggcgtggcgctcccgaggacgaccggacagctgtgatgctcggcccggcggatggctacgtccttcgcatgatatcgcggcatttcctcctgcttataggaagattcgtgctcttcatcaataatgatcatgccgagattttcaaacggggcaaagatggccgatctggctccgacgacaagccggacttccttgcgctgaatcttccgccattcatcgtatttttcacctgtggataatccgctgtgcatgaccgcaacctgtgagccgaagcggcctttaaaacggttgaccatttgcggtgtcaacgaaatttccggaacgagcacgatggcttcttgtccttttgccagcactttttcaatggattgcaggtaaatttccgttttgccgcttcccgtgacgccgtgaagcagaaagacgtgatggacatggtcggctacagcttgtttaatcggctcaaaagcggcctgctgctcttctgtaagagagagcggctctgtttttttgaacattctgtcctgataaggatcgcggtaaacctcctcaaagctttccgtaagaagcccctttttaagaagcgttttcagcgtcgcggaactggaatcggtctttttgcaaagttcagccgcggaaatcttttctcccccgccgataaaataagtaagcacggcgagctgtttagaagcctgctttgtcaatgaatctgcgtgccgggcgagttcttctttgtctgcccccgcttcaatcatgcggatcatttttttattcgttttttgggcgactttatatgtgacatcaatgcttcctttacgcacgaatttctgaagtgacgaaagaatgctttcatcggtaatatccgagtacagaagacttttttgattcctgaaaagctgtttgatgtccggtgtcagcgcttcttcgtcaacgactttcagctctttctcgtacttcgccttcaatgcggcgggcagcattgcctgaagcgccgtgattttaaacgacagcgttttgtcagaaagccatgaagacagctgcatcagttcctcagtcagaacaggcgtcaaatcaagaagcttctcgacttccttcattgagccgccgtttaattcggacgaatctttcaaaccggtcacaaatccttgaagcttgcgcgggccaaacgggacaatcacccgcatgccgacttcgatcatcccttttaaatgatcgggaattttgtaatcaaagggtctgtcaatgtttttggagctgacatcgacaatgacttctgctacattcatacgggttttcggtcctcggctttcaaagctgtcatttccttcagcatttcaaaggaaacgtcaagtttagacataagcgcaagctcccgttttcttccgtcccggaaatagaaggtgacgacattcgtatccgtgccaaatccggccccttccgctttcacatcattcgcaacgatcatatcaaggtttttctgttcgagttttctgcgcgcatagcgttcgacgtcttgcgtttcagccgcaaatccgaccagcagctggtgtgttttccgttcgccgagttctttcagtatgtctgccgtacggttgaattcgatcacgagcgaaccgtctttcttcttcattttgtgatcagaaacagccgccggcgtaaaatcggccacggccgccgtcttaatcaccatgtcgcatgaatcaaacacagaaagcacggcttctctcatatcggctgccgattgcacaggaagaaactgatacagcccgactggcggctctattgacaccgggcctgaaatcagcgtcacccgcgccccgagacggacggcggcttcagcagcagcgtagcccattttgccggtggatttatttgtgaagaagcggacagggtccacggcttcgcgcgtcggaccggccgtaatgacaatatgttttcctttcagcggcgcatcgtcttcaggctccttaaaatgctctctgacacgctcaacaataagctccggctcctccagccttcctttgccgacatatccgcatgccaaatagccttcactcggctcgataaagcggaccccgtcctgataaagcacagagatgttccgtttcaccgccggatgatcatacatatggacattcatcgcaggcgccacccagaccggggcctcagccgccagcaccgtcgttgtgagcatatcatcagcaattccgttggcaagcttgccgataatatttgccgtagcgggcgcgacaataattaaatccgcccagtcagcggcatcaatatgagaaatcaccttcggattttgttcattaaatgtatctgtatacacttcattccggctcagcgcctgaaatgtcagcggagaaacaaactcacgcgcggactcagtcataatcactttgacatttgcgccggcctgaaccagcttgctcgtgagtgcggaagctttataaacggcaattcccccgcttacgcatagcaaaatgtttcggtttttcatgaagtcttctcctcctttatgaaagcattggacaaatcccaaacggaaaaaaataacaacctatgtagagataggttgctacgtgtgcttgttattcgctgtcttctctttcaaacgaaagcaggcccgcgtcaatttcttctaaagctttgcctacatatttgtgagaaatggtatgttcaatctgctggtcctttttgatctgcatttcacgcgcgcgtcttgcagacacagtcaccagcgtatatttagaatctaatttattcattaaagagtcaattgacggatctaacataagttattctacctccagcattttcttatatctcggagcaacgcgttcacgttttaagtgctcggcgagaacgattgcgttaatcttatcacaagccgtttggatatcgtcgttttcaacgacataatcatacgcgtccatcatttcgatttcagcttttgcggcattcattctgttttcgattaaatcgtcggtttcagtccctcttgtcacgattctgtttttcagctcagaaagactcggcggcgctaagaagataaacaggccttccggaaatgcattccgcacttggagcgcgccctgcacttcaatctctaagaagacgtcttttccttcttgaagcgtctgttcgacataatcaacgggcgtaccgtaatagttgccgacatattctgcccactcaagcagtttgttgttttcaatcatgcgctcgaattcatctctggatttaaagaaataatcgacgccgtcgacctcgccctctctcgggtttctcgtcgtgactgaaattgagtattcaaatttcgtgtcctgttgtgaaaatattgcttgccgaaccgttccttttccaactccggagggacctgagagaacgattaataaccctctttctttcatgcggcaattacccctgcccttcatccataatttcttctttcacagaaagtctgtgtgcaactgtctcaggctggacggcagataagataatgtgatcactatccatgacgacaactgcacgggttcttcgtccgtatgtagcgtctattagcattccgcggtctcttgcatcctggatcattcgctttattggcgcagactccgggctgacaatcgaaatcatccgattggcggagatgatattgccaaatccgatattaatcagtttaatcgtcatcttctacgttccccctgtaaaatagacgtctctagtgtaacctgaagagaccgtctgtaaacaatacgcacagtcgctattctatattttgcacttgttccttcaatttttcaatagaacttttcatttcaacgacaagctttgtgatttgatgatcattggcttttgagccgatcgtgttcgcttcccggttaagctcctgaacaaggaaatcaagtttgcggccgactgccccgccttcttttaatatatcacggaattgaacaaaatggctcttcaatctggtaatttcttccgttatatcagaacgatcggcgaaaatggcgcattccgtgatcagcctgctttcgtcgagcgcgtcctccgtccattccttcattcgggcgtaaagacgctcgcggtattgaataacaacggccgaagcgcgctctttcacctgttcggacagcgtctcaagccgctcaatgtgcagaaagcagtcttccgccaaaagccggccttctttttccctcatgtcacaaagttcctttacagccagctcagcggcttccctgatgacttcttcaagcttgtcatcacgcatctgttcttcgtgaatctgcgcaatatgttcaaatctaaagaaatccattgcatcgggttctgcggccaggctgtagcgctctttcatggcgcgtgcggcgctcacatattcatcaaggagctcccaatcgatgttcaggcttctttttatgagcgcgtcactgttgacagtgagaaacagctctactcttccgcgctgtatatgctgcaatatcgtttgtttcagcttatcctctacatatagcaaaggccgtggcaggcgggcgttcacttctttgaaccggtaattgacggatttcaattcaacggttgccgagagatcgccttttgtgctgcttgcgctgccgaagcctgtcatactccgtatcatatgaaacacccaattctttcccgttatcaaaataaaagggcaatagacatgctattacccctaagattatatcatatggaattatttttttcttgtcaaaagtgaacccgccagcaaaaaagtaggtatgccagacatcccgataatcagcatccaatcgcccggcgtaatcggcactgttttgaaaatcggctgcagcggcggataatagatgacgatggccatcaggaagacagaagaaacgatggcgccgagcagataaatattttcaaacggattccgggagaaaacagacgtttcgctccggcagtcaaacacgtgtataagctgagccaggacaagagtcgcgaatgcaacggtctgtgcgtagggcagattttcaggattgcggtgatagacgatgataaacgctaaaatggttgcggctccgattaaaaaccctcttgatacgactttccagcccagttttctcgcaaacactccttctttcggatgccgcggcttccgcctcatcaggtctccttccggctgatccataccgagggccatcgccggcagcccgtcagtgactaagttcacccacaatatctgaatcgggacgagcggcagcggcagagcgagaagcatcgcaaacagcatcactaaaatttcaccgacgttggaggccagcaaataccggacgaattttcttatattttcatagatattccgtccctcttttatggctgatttaatcgtagcaaagttatcatctaccagaatgagagaagaggcttcctttgccacatccgttcccgtcacgcccatggcaacaccgatatctgcctgctttatggccggcgcgtcattaaccccgtctcccgtcatggcgacgacgtgtccgttttcctggaacgctttgacgattttcaatttatgttcaggtgacacgcgtgcgaagacgtagacatcatcgaccgtttcgataagttctttgtccgtaagctcattcagcgtcttgccgtccatcacacgcccctttttcggaagaagacgcaaatcttttgcaatggcctttgccgtttcgacgtgatcccctgtgatcataaccgttttaatgccggcttcacggcattctttaatggcctgtctgacctccggacggggcggatcaatcatgcctgacaagccgagcatcgtcagatttttttccgcctgctccattgtcggcttttctccgggcttaagcggtttataagcaatcgcaatcgtacgcaaagcttgcgacgccagctctttcagaaccgcttccgtttctgctttcttttctcctgaaaaaggcgtacttcttgcgccgtgcatcagatgtgacgagcggtcaatcagcacatcgggcgctcctttagtgatgacgaactgctttttttcctgatcctctacaatgacggtcatcattttgcggacggagtcaaacggaaactcggcaaccacgcggtaatgcccgctgagccaatcgtttgaatagccgccctttcttgcagccgtcagcagcgctccttctgtcggatcaccgtcgagtacataacggccgtctttcagtgcgatttcagatgtgttgcacaacgcgccgaaaaccagcatctgttcaagaatcttctcatctttcggcttgatttcccgctcatctcgggtgaaaacgccctccggcacatagccgatgcctgacactttataaattttgccgcctgaccacatatgggtgacggtcattttgttttgtgtcagcgtgccggttttatcagaacaaatgacagaggcgcagcccaatgtttcaaccgccgggagctttctgacaattgatttttgtttgatcatgcgctggacgccgattgataatgccaccgtaacaatggcgggaagcccttccggaattgcggcgacggccaatgacaccccggccaaaaacatgctgtaaagatcatgtccctgtaagacgccgactgcaacgaccaataccgttaaaaggagcgcgacgataattaaaattttgccgagctcttcaagtcttcgctgcagcggtgttgaaaggctgccggcggattccagcatatcggcaattttccccattgccgtattcattcctgtaccgacgacgacgccgacaccgctgccgcgcgttacgatcgtacccataaacgccatattgctgatgtcgcctaacgaaacatccggctttctcaatttatcggcttgtttaaccaccggaattgattccccggtcagcgccgattcctcaatttcaaggcttttcgcttcaacgatccgcacatccgcgccaatccggtcgccgcttgaaaatttcatgatatcgccgggaacgagctccttggactgaattttcttccagctcccgtcccgcaacgctgacacatacggcgttgacagctcttttaatgcatgtaaagacttttccgcccgccgctcttgaaaaaaaccgagaaccccattgacaaatacaatcgccataatcgctacggcatctacatattcgcctaaaaacccggatattaaggttgccgccagcagcacgagcaccataaaatctttaaattgggcgaaaaacacggcgatcgccggtgtcctcttgccctcctgaagctcgttcggcccgtgcttttcaaggcgttttttcacctctttttcggtcaacccctgtttaatggacgtatttgttgctttcagcaaatcggtttgtcccatttcatgaaacttcattcttctcgtccactcccctgcctcgctttagagatgtcactctgtaaacaagcttattctgactcgtcccttttcatgctataattatcgaatgcaggaagaaggaaagggtgttttatatgtcttttgatggcatgtttacatacggaatgacacatgaattaaacagccggatcgccggaggacggatcacgagagtccatcagccttttaagcacgatgtgatattccatatccgcgccaacggaacaaaccacaaattattattgtcggcgcatccgagctattcacgggtgcacatgacaaaccaggcctatgaaaatccgagcgagccgccgatgttttgtatgctgctcagaaagcatatagaaggcggatttattgagaaaatagaacaggccggattagaccggattatgatattccgcataaaaagcagaaatgaaatcggcgacgaaaccgtaagaacgctgtatgttgaaattatgggacggcacagcaatattattctgactgacggagaaggatccatcatcgacgggctgaagcatttatctccgtcgatgaacagctaccggaccgttctgccgggctatgattacaagcttcctcccgctcaggaaaaaatttcgccgcttgccgcggatgaagaggacgttttgcgttatctcagttttcaggaaggacggcttgaccagcagatcgtcagacatttctccggtgtttctccgctgtttgcaaaagaagccgtgcacagagcgggtctcgctaacaaaataacgctgccgaagacgctgattgaaatgttccatgccgtgaaagattgcaggtttacaccgaacattacgacagccggcggaaaggaatacttttatctcctgtctctcacacatgtaaacggagaggagcgcacctttcactcactgagtgagctgttggaccggttttatttcggcaaagcggaacgcgaccgcgtcaaacagcaggctcaggatctcgagcgttttgtcgcaaatgaacggaaaaagaatgccaataagataaaaaagctggaaaagacgctcgactactcagaaaatgcgaaggaattccagctatacggcgaactgctgacggcaaatttgtatatgctgaaaaaaggtgacaaagaagcggaagtcatcaattattatgatgaagaaagtaagacggtgaccatccctttaaatccgaacaaaacaccgtcagaaaacgcgcagatgtattttacaaagtatcaaaaggcgaagaattccgtcgaggtggtaaaagaacagatccgtctggccgaggaggaaatcgcttatttcgatcagctgatccagcagctctcctccgcctccacaaaggatattcacgaaataagggaagagcttgtggaaggcaaatatctgcggccgaaacagcagagaggacagaaaaaacagaagcagcacgttcctgttttggagcaatatgaatcttcacggggattgacgattcttgtcggcaaaaacaataaacaaaatgagtacttaacgacaaaagctgccgcgagggatgatttatggttccacacgaaagacattccgggttcccacgttgtgattaaaagcagcgatccggatgaacaatccatactggaggcggctgcgatcgccgcttatttttccaaagcgaaagattccggctccgttccggttgattatacaaaaatcagacatgtgaaaaagccaaacggcgcaaagcccggatttgtcacctatgacagccagcataccgtatttgtcacacctgatgccgaccttgtcatacggctgaaaaaataaacgcacctccaagctgaaacccgcactcggcttggaagtgttttttattacgtataaacggagacgaaactctcccagccgtcagaaccgatctttacagtatctgatcagtttcccgtcatgtctgcatgatccgccgggccgtctgtgatttaaacggtcacacctgatttggcggcggatactttcaccttccctcgccgaacctgagcacatccgggcgggtctctgacctttcctttgtatgcgggcgaaatccaggcggcatcgggatcacatacatattccgcatcacttcgcaatcctgaccgcttgtcggcatataccattcaaactgcccgctttcgttttgaatttttcacattcggcggactgtcaggacagtataaaaaacaccctgcctgatgacagacagggtgttttttatggtcttcttcttttctcaaataatcgatccacttcttcagccaaatcagcagtaatgagaggctttatgtcctcagccagtcttttcgtatgtgcagggcttgcgccgcttgttgatacggatacttgaatgcgccctttgcggatgatcttcggcatatacacgctgccccgttcagcctcgcttacacaattgaccagctgcgtttcagaagcgccctcggttatctcccgattcacgttgcggtcatttgtcgcggcaatgatgaaaaaagcgggcgcgagatccttcatgtcaattttacgggaaacccagcggatacgtccttcatccgccagctgtttaatttcaggcagggcatcgggactgattacagtaatatccgcgccttccgaaagcactgttttgagtcttcttaaggcaacattgcctccgcccgcgatgacaattctttttccgctgagattaatgtgcagaggcagcatactgtccccccttaaaatcaaactgcccgccggggtttcggacagcttccgtcacacggttcaaaaacgcctgcttaatatgcgggtgaaaacctaagtatgaagcgagatgaacattttgattgaccgtttgaagcttttgaacttcccgttcaatctcagtcattaaaagcccggtaaacagaagatatggaacgataaaaacgggtgctccgtcatcctcttcaaggccggcaaacacttctttatagtgcgggtcacatgctgttaaaaaacaagggatgacttctttaacaggtgtaatcgcctcaagttttccggcaatctcactgactgcgcttttaactgccggatctgtgcttcctcttccgatcagcaccactttcgcctgctcaatggacactccggtatcttcaatgcgatgatgcacggcttttacgacttcatcgtccactccgatcggaacaccatatgtcacttttatatcgggatgcagggccgccgcacgggcgatttcagccggaatgtcatgtttcgcgtgggcagcggtcaacagcagcaaaggcacagccgcaatatgagtggcgccttgtctgacacaagcttcaaatcccgcttcaatagacggttcctgcagttctaaaaaacagatttcctgaatgggagcgtcagcgtgtggcatgcacccttttaaaaacgccgccgactctgtctgcgcttttttcagcctgcttccgtgtccgatatataaaatcgcctgcttcatttacaacgcctcgctcaaatccggatttttctgatcagatgcataccagtccagtatgcagtgataattgacgacatcaccgataacaattaaactcgggtttttgatttcttcttttatcactgtgtctgaaagcgtgccgacggtgcagacgactgttttttgcctgtccgtcgtcccccaatgaataaaggctgccggagtgccgccgtctctgccgttttccagcagcattctttcaatctgccggatatttttaattcccatataaatcaccagcgtatcaatgcccgtcgccagcgctttccatttttcttcaaagtcgtcttcttgtttataatgccccgtaacgaatgcgacattggagctcgcctctctgtgcgtcaccggaatgccggcataagcagcagccgcgattcctgatgtaatgccgggaacgatctcaaacggaatggcgttttgcgcgagagcctccgcttcttcgcctccgcggccgaaaacaaacgggtcgccccccttgagccttacaacggttttcccctttttcgcatacttcacaaggaaacggttgatcgtatcctgtttcataatgtgaaaatccgggagcttgccgcagtaaatcagatccgcttcttctccggcgtactgtaaaatctctttgtttaccaatctgtcatataatataacgtccgctttctgtatggctttcattgccttcaccgttaataagtccggatctcccggaccggctccaacgataaatactttccccatagcatgtctccccgatccgttttgaaatcttcccagaacagccgcgaggccgcacttcagctattttaccatatcccgccattgcgggggatatccggctgattgcgcggcctttttggacctattatgctaagctgtttttcacaaagtcaaccagtcttccggtgcattcttcacgttcaaatttgcctgaatcaagtacgagctcaggcgctttcggctcttcatacggtgagtcgatccccgtaaagaacggaatttcaccatttcttgcttttttatataaccctttcggatcgcgcttttcacatatatcgaggtcgcatttcacgtagatttcattaaattcgccctctgccacaagctctctcacctgatctctgtcctcacggaacggagaaataaaagccgtgatgacgatggttccctgctgaacgaaaagcttcgccacttccccgatgcggcgtatattttccttgcggtcatcatcggaaaaacctaagtccttgtttaagccgtggcggatgttatccccatcaagcacaatgacttgatagccttgttcaaacagctcgcgcgctgcggcgtttgcaattgtggatttccctgaaccgcttaagcccgtcagccagaggatagagcttttatgcttgtttttctgctggtattcttctttcgttattgaggcttcatgccatacgatatcacgatttgtcactctattttcctccttaagaaacgcctgcttcttctttcgttttcagccctttaatcaacacctcgacaacttcaggacggctgaattccgccggcggcatgacgccgcttcgcagcatttctctgacctttgttcctgacagaatgacgtggtcttctctgtcatgcggacatgttttggccgttcccatgttgccgcatttctggcagaagaagctgtgctcgaatttcatcggtgtaattccgagttcatccgctgtaaattgatcaaacagctcttgcgcttcatatgtgccgtagtaatcaccgacgccggcatgatcgcggccgacaataaaatgcgtgcagccgtagtttttgcggacaagcgcgtggaaaatggcttctctcggccccgcataccgcattgccgccaaaaacacgccgaggaatacgcggtctttcggataataatgatcgagcagcacctggtagctttccattctgacatccgccggaatgtcatctgattttgtttcaccgacgagcgggttcaaaaacaggccgtcaaccgtctcaagcgcggttttttggatatattcgtgggcgcggtggaccggatttctcgtttggaaaccgacgatggttttccagcctttttcttcgaagcttcgtcttgtatcggcaggttcaaatgtaaactcaggaaactgctttgacgcttttttaattaatgtgatcggcccgccgacatacgtatcgccgcgtgaaaataattttttcacgcccggatgcgcggcatcatcggttttatatacgtgaacggcttctttttgtttatccggcgtataaatatcttcgatgtcgacgacgccgtatgtttctccgccgtaagtcagtttcaccgtgtcgccgacggcaagctcagccgctttttctgaatcgaccggaagcgtgatcggcagggaccagacaacccctgatgctagacgcatattttcaacgactgatacgtaatctttttctgtgaaaaatccttcaatcgggctgtaccccccgatcccgatcagctctaaatcagcgaacgaaatcaaatcaagctcaatttctttgtggacggatgtaagatcatactgctcattcacccgattaattaatgttcctccgtgcggtgctaaactcataatacatgattcctcccagttaacagataaataaactcagattaatagttaaatgcccccgccttgttcatggacagagcgtttctcttttcggatggctttcatcagactggcggctccgccagctgccaaaagcacgctggccatcataaagatggaatagtaatctccttttaacagcagggagacaagcagatacgaaatcgacagtgacaaaaacggcgaaacaacccatactttgagcatcgttttcacgacttctttatgaaaaacgttcggcccgtttttggccattccgataccgataattgatgatgatgtgacttgcgccaatgggaccggcagaccgaagacggaactgataatgacaagccccgcaccggttcctgaaagcagtatgccttctccggctgaaaacctcgtaatctttttcccgttggtttcaagcactttgcgtcctaaaagcagagcgccgagagcgacaaagatgcctccgtacagcgttccttttgacacgctgagtacgcccgcagccaccaaagggcccaccgcatttgcgacattgttcattccggctgaaaaagcttcccaaaaccccgcaaaaagcagcacaattcctaaaatcttctgtttccgtttcgaaatgactcgaatattcagagaactgaataccttcgatacgagaaaagtgaaacagaacgcgacgaacggtacgagcacccaaaaaatcacgatgaccaaaagatgctgtaaaaacaatactttgtacgcgacgccgacaccgacaatcgccccgacagtgacctcactcgtcgacagcggaatgccgagcacattcgccgtgaataacgatagcgccgccgctccgattataatgcagacaatggtgagcgtaatggtttgttcgggaatgattccgccgctgatcgtcttaacgacttcaccgccgccgataaccgcccctgacaggactccggccgcgcagatgatcagcgcatacgttttctttttaacggcgccggacccgtaagcgactcccattgatgccgcggctccgctggctccgatattcatggcaaaaaacagacagaataaaatagcggctaattccatcgggcagctcctttattcatgcagtccgcattctgttttcgccatgccgttccatctgccgctccgcaaatcttccgcggtaaacgcaggtgaagtgcacggttcacagccgatgctcggatacccctgatcatggaggatattgtaatccagctcatgcttggaagtatatctccagatgtctttccatgtccaatggatcagcgggcatactttaatcgattgaaacttgtcgtctttattcaggaaattcgtattcgcccggctcggcccttgatcccggcgaaggccggacagccatgccggatgccctgcgagcgcttctcttaacggcagaatttttctgatgtagcagcactggttcggttctctttcccacagtttatctccgtgagcctcggcctgttcctcgagagtaaggctgggctttttcaggataatgttcagccccggataacgttctttcactttttcgatcgtttcatatgtttctttaaagtgaagacccgtatcgagaaacacgatttccgcgtctttctttactttagaaattaaatcgatcaggacgatgccctcaatcccgaagctgcacgcgtaaacaagctggtctccgtagtggccgtatgcccattttaaaacggacagcgcgcctttataggaatcgtcttccggaaatgtaatcgccggttcctcccatgtatcatacgttagcattttttctttcctcctcccggagacaatcaaacagttgttgttctctgccggttgtcttatccctcaatctttttttcatataaaaaactttcaatccagcggaatgaaagacagtgacccggtatagcccttatcttcaaaatgctgtgcatttttctggatgcggcaccttgcaatacacgcaggttgccgggcgtcatcggtccagtccctcagccgctcttgataagctttttagatttgtactaaattttagcacaattctaacagaagtcaacccgagttttttgataggaataataaaacaggccctgaggcctgtttttattgtcattattttttaaaccaatcttttgactcgggattcagtttccatgatttcagtttttcaatgtcagctgaatgaatcgtaccgttttcaagcgcgacttcaatcagcgtgtcataatcggttaacgagtaataaggaagacccgcttttttaaaggcttctgttgctttcggcagtccgtatgtaaaaatggaaatgacgccgaggacttccgcgccctctctttgaagggccgccgcagcttcaagcacgctgcctccggtagaaatcaagtcttcaatcacgactgttttttgtcctttcttaatggcgccttctatttgatttcctttgccgtgcgctttcggtttgcttctgacgtagcacatcggcgcgcctgtacggtctgcgagaagcgcagcatgcggaatgcccgccgttgcagtgcccgcgatcatctccgcctcggggaaatgctccttcagcagtttgccgagcccgtccgccacatcatttctcacttttggatacgacaatgtcagacggttgtcacaatagatcggtgataaaatgccgctcgcccacgtaaacggctcattcgggcgtaaaaagacagcttcaatgtgtaatagatgttttgcgatagcctgtttcatcggcgaacgccctcccattccagtttaattgcttcatatgctttaacggggttttccgcttttgtaattgagcggcccacgacgatggctgacgaaccgttttctttcgcaaatgacggagtcgccgtacggacttgatcgtcagctgcgtcactggcggtgcggatgcccggcgtgactgtcagaaatgaaggccggaccgcttcataaatggcttttgtttcatggaccgaacataccactccgtccagcccgcactcttccgccattttgccgtaatgcacaaccgtttctaacagcggcttatgcagcagaagctcttccttcgccacctgctctgaagtgctggtcagctgagtcaccgcgattaaagacgggcgttttctgcctgccggcgtgccttcttcaagcccctcaagggccgcgcgcatcatgcgtgcgccccctgccgcatgcacattgacgagatcaacgccgaggccggccagccgcttcatcgctttattgaccgtagtcgggatatcatgaagctttaaatctaaaaatatatcacagttccgttcttttaattggtgaatgatggcggggccttcctgataaaaaagttccatccccgttttgacaaagagcctttccttttcaaacaagtctaaaaacgttaaagtctcttcccctgatgcaaaatcaagcgcgatgatgggcaggttgtttttcatgtttccagctccttccgatgcattcacttacagattgaaagccgtgttggcgcagcacgtgggggagctgttctatgatttccgggcagacgaacggattgacgaagttcgccgtgccgacggcaaccgcactcgctcccgcaagaagaaattctaatgcatcctctgcggtctgaacgccgcccatcccgataatcggaatttgaacggcctggctgacttcgtataccatccggatggcgaccggtttgatcgccgggcctgacagtccgcccgttttatttgctaaaatcggccggcccgtcttgagatcgagcctcatcccgatgagagtattaatcatcgtcagaccgtcagcaccggccgcttcaatcgctttggcaatttcggctatgtttgcgacattaggcgaaagcttcacatacacaggcactgcggaaacttctttcaccgcttttgtcagttcggccgccatgacgggatcagtaccaaaagcaatcccccccgttttgacattcggacatgaaatgttaagctcaagcgcatgcacattcggcgcttggctgatgtgctcggccacttctttatagtcgtccacctgagaaccggcgacatttgcgataatcggcgtgtcaaattgttcgagccaaggcagctcgtgattgagcacatgctcaaggccgggattttgcagtccgatggcattcagcattcccgcgcttgtctccgccactctcggcgtcggatttccgaagcgggcttcgttcgtcgtggctttaatcataatgcctccaaggcatgataaatcgtaaaatccggcatattctttcccgaaaccgaaacatccggaagcggggatgatcgggtttttcaattggagacccggcagattcacctctaacattacagcgccacctcctcagctttaaataccggcccgtcaaggcagacctttacataggatgtatcgctttcacccgtgcggcacacgcaggcgaagcaggccccgatgccgcagcccatccgctcttccatcgaaagataaacctctttatggccgtactgctgcttcagagctttcagcatcggtgtcggtccgcagcttagcaggacatcgaattcgagctgcttttcacggatgatatcggtgacaaatcctttctctccatatgttccgtcagccgtcgccacataagtgtctccgtacgcacggcattcctgttcgtaaaaaacatcctttgctgattgaaatccaagcacatgaatgacgtttacgcctttttccgtcaggcgctttgacagttcctgcaaaggcggaacccccactccgcctccgactaacagcgcggttttgccgggttcaatccgccgcacgggaaatccgttgccgagagggccgagaacgtctattttgccgccctcttttttcccggacaaaaggcgcgttccctcaccgtcagctctgtagataacggatacttcatccgcggcgaaattgacgtccgcaatgctgagcggtcttcttaatagcggtgtgaccgcgtcactcaccttcagatgaagaaattgtcccggctcggtaaggtgccggacaagctctcctttcagcaccatcttataaatccggtcggcaatttctaagttggattgaacagtcaaatgcgcttttttcatatcgtgactgccgccttttgattggtttcggatgcaggcatatgatccgcccggaatgtcatgctttccaatacccgcaaaatggcttcggccgtatctaaagatgtcaggcaggcgactccgttctcaacggattcgcggcggattctgaagccgtctctggccggctgtttgccctttgtcagcgtattgatgacaaattgcgcttctccgtttctgatcacatcgagcagatttttcccttcttcgccgattttcccgacgacttgagccggaatctgagcgtctttcaaataagccgccgttccttccgtcgccaagattttatagccgatggcgtggaaccgcttggcgatcagcagtccttcttctttatctttatcagcaacggtcaacagcactgaaccgtagttcgggatttgaatgcctgaggcaatcagcgctttatagagcgctttttccaaggttgaatctttgcccatgacctctcccgtcgacttcatttcagggcctaacgtgatatccactcttctcagcttcgcgaatgagaagacaggcgctttcacgaacaccccctgctgttcaggctgcagcccctcttgatagccgaaatcagcaagcttttggccgagaatgacctttgtcgccagattcgccatcggaatcttagtgattttgcttaagaacggcacggttctgcttgaccgcggatttacctcaagcacatacacctcaccttgcgaaagtacgaactggatgttcagcaacccgatgatgttaaggccttttgccaaggcaacagtgtattgttcgatttttttcttaatgtctccgcttaaagactgaggcggatagacggcgattgaatcccctgaatggacgccggcccgctcgatatgctccataatccccggaataacgactgtttcgccgtcagatacggcatcgacttcgatttctttccccgtcagataacggtcgattaacaccggatgctgcgggttgattttgaccgcatttttcatatagtgaagcagttcttcttcgtgatagacgatttccatcgcccggccgccgagcacatacgaagggcggacaagtaccggatagccgatggatgcagcgattttgaccgcttcgttcaccgacacggcggtttttccgagcggctgcggcacattcagcgcctcaagcgcctgctcgaacttatcccggtcttccgcacggtctaaatcttcaagtgatgtaccgagaattttgacgccgcgggcgctcaattcttccgcaaggttgatcgccgtctggccgccgaattggacaacaacgccttccggctgttccaaatcaatgatgtgcatgacatcttctaccgtcagcggttcaaaatacagtttgtctgatatgctgaaatcagtggacaccgtctcagggttgttgttgataataatcgcttcatatcctgcctgcttaatcgcccagacagagtgaacggtcgcatagtcaaattcgacgccctgtccgatgcggatcgggccggagccgaggacgacgacgctttttcttgatgttacctcagactcgttttcttcctcatatgtgctgtagaagtacggggtttctgattcgaattccgccgcgcatgtatccaccattttatatacaggcttgatggctgcttcttttcgcatttgatacagctcttgttccggcatattccattcccggctgatatatttgtcggagaaaccgagttccttcgctgtctgcaggacggcgaggctgcctttttccgctttcagctcggtttcaaaagcgaccagcttacagagcttgtgcaaaaagaatacgtcaattgcggaaaactcatgaagctgctccactgtgtagcctcttctgaacgcttctgcaagataaaacagccgttcatctccggcctttctgatccgtttttccaaaagcccgtcagaaatctcttccgcatccttcagttccaggtgatagacatcggcttccagtgagcggaccgcctttaacagcgattcttcaagggtgcgtccgatggccatgacctctccggtggctttcatctgcgtcccgagcctgcggtttgccgactcaaatttgtcgaacggccagcgcgggattttagaaacgacatagtcaagcgcgggctcaaaagccgcatatgtttttcccgttacgggattcatcatttcatcaagagaaagcccgactgcgattttcgccgcaagctttgcgatcgggtaacccgtcgcttttgaagcgagggcagatgagcggctcactcgcggattcacttcgataatgtaatattggaagctgtcgggatcgagcgcgagctgaacattacagccgccttcaatgccgagcgcgcggatcagctttaatgaaacattgcgcaaaagctgatattcccggtcgctcaaagtctggctcggggcaacgacgatgctgtcgcccgtatggatgccgaccggatcgatattttccatgttgcagacgacgatcgcgtgatctctgctgtctctcatgacttcatattcgatctctttgtaaccggcgatgcttttttccagaaggcactgatgaacggggctgagctttaatccgttttcgacgatctctttcagttccgcttcattcgagcagatgccgccgcccgttccgcctaatgtgtaagcggggcgcacgataaccggaaacccgatccggccgacaaattcctcggcttcctgtaaagtgcggatgatctcactttccggcaccggttcattcagctcattcatcagcgtacggaataagtcgcggtcttcagcctgctggatggcggacagctttgtgccgagcacttccactccgcattcctcaagaaccccgagttcagacagctcgacggcaagattcagtccggtctgtcctcccagagtcggcaggatggcgtccggccgttcttttctgataatacgcgtgagaaactccggcgtcagcggttctatgtatacccgatcagccatttccgtatccgtcataatcgttgccggattcgagttgacgagaatgacttcatagccttcttcctttaaagcgagacacgcctgtgtgcccgcataatcaaattccgccgcctgtccgataataatcgggcctgatccgatcactaaaatctttttaatatctacgcgttttggcataccgcttccccttctttctcagttgtttcgatcaagtcaatgaatctgtcaaataagtgattggcgtcttccggtcccggtgaagcttcagggtggtactgaaccgtaaatgccggcaatgttttatgcttgagtccttcgatcgtttgatcattgatcgcaatgtgcgtcacttcaagctctgtctcatctattgaagaaactgtatatccatggttttgggctgttaaagcgactttccctgtcgcaagctctttaaccggatgattggaacccctgtgtccgaatttcattttttccgtttccgctcccgatgccagcgcaaataattgatggccgagacagattccgaataacggcaccttcccgagtatgccttttatcatttcaatggcttccggcacatctttcggatctccgggtccgttagaaagcatgatgccgtccggcttgagctgaagcacttcttccgccgttacattgtacggtacaacgatgacatcgcattttcttttgtttaactctcttaagatgccgtgcttcataccgaaatcgacgagcacgatgcgtttgccgcggcccggactcggatatgccgttttcgccgatacttgagcgacttgatttctcggcagttccgtttctttcagccttgcaagaacctctccgacattctcctcacttgaagcaaacgttccttttaatgccccggccgtgcggatcattctggtgagttttcgcgtgtcgatcccttgtaagccggggatttttttcattttcagatactcatcaagcgtgtaagctgagcgccagttggaaggcagctcgcacagttcttttacgatcagcccttttacaaaaggagtgatagattcaaagtcatctctgttaattccgtagttgccgatcagcggatacgtcagcgtcacgatctgcccgcagtaagaagggtctgataaaatttcctgataaccggtcattcccgtgttgaatacgacttcacccgcggtatgctccaggctcccgaatgcttcaccctcaaataccgctccattttccagcactagtcttcttttcatttgacgagtctcccttcttcatatgcaagcttaccggcagccatcgttgcaacaggccagccgaagcacttcatcttgttgaatggcgtattttttcctttagataaaaatgtatctttgtcaatggccgcttctttgtccagatcaattagggtgatgtcagccggcgcccccggtgcaagcgttccgtacggaagaccgaatgcctcgcaaggttttaccgtcatgaaatcaaccagctgcttcagcgtccacgtcccgtttttcacaaaatgtgtgtacagaaggggaaaggcagtttctaacccgacaataccgaaaggcgcaagcttcatgtccgtgtttttctcttcttctgtatgcggcgcatggtcagtggcgatgaaatcaatcgtgccgtctaaaagcccttcaatcagcgcctctctgtcctctttgctgcgaagcggcggattcatcttaaaattggtatcaagtcccgggatatcttcgtcacaaagcagcaggtggtgcggcgatacttccgccgtcacgcggatgcccgctttttttgcgtctcttacggctctgacggattctttcgtgctgatatgacacacgtggtaatggcagcccgccgcttccgccagcagcacgtcacgggcgatatgtaccgcttcacaaatggaaggtatacccttcaggccgttcgcttttgaaaaagaaccttcatgcacgctccctccgtaaataagtgagttatcctcacaatgagcgacaatcgctttatttattgaagccgcccgtttcatggcttcatacatcattccggccgtctgaactccgacgccgtcatcggtgaaggcgaatgcgcccgcttcatgaagcgcctcaaaatctgtcatctcttcgccggtttgtctgatcgtaatcgatgcgtaaggaaggaccctgacagatgaggtttctttgatcctgttttgcagccattccatctgctctttcgtatccggcaccggccttgtattcggcatggcggcgactgtggtaaaaccgccccgcgccgcggctttagagcccgtctcaatggtttcttttttctcgccgcccggttctctgaagtggacatgaaggtctacgagcccaggtgaaacgaacagtccctcagcgtcgatcaccgtttctccgtctttcgctgtcagaagcccggtttccgaaatgaattcacccgttacccggatatcatgtaccgctttttctccctgttcatttaatatccagccgtttttaatgagataagacataagccgcttctccccttttcacattggtttgcagtgctctttttaagactgccattctgatatacacaccattttccatttgtttaaagattcttgattttccgcattccactaatgttgtgtcaatttcgactcctctgttcaccggtgcgggatgcatgatgatagcatgccgcttcatgctctgcgcccgcttttcggtcagcccgtatgcttccaggtagcctttttggtcggcttctgtctgatgcctttcattttggatgcggagcagcatgacgacatctgaagcttgtatggcctcatccgtctgaacacaggtgccgaaggcgtttttctcatcctgccactgcggcggcccggaaaacagcacacgtgcgccgagccttgtcagcacctcggcatttgaccttgccactctgctgtgtttgatatcgccatgaatggaaaccgtcaggccctgaaaggtctcaaattcctcttgaatcgtcattaaatcaagcaatgactgggtcgggtgctgtccgcagccgtctcctgcgtttaagaccggaatattgactctgccggtcagatctttgtaatattcatccgtgctgtgcctgatgacgcaggcgtccgctccgattgattccagtgttttgaccgtgtcgtataaggactcgcctttttgaacgcttgtgctcgtgccgtctaagctgagcacgttcatcccgagtttcttttccgccacttcaaagctgaaccgcgttctcgtgctcggttcaaaaaacagattcgcaacgaattttcccgcgagatcgggacggactgcaccctcttttatcgcttttgcctctcgcagcagttctgtaatttcagccgcgctcagttcagacatcgccgttaaatgattcatgttttttctcctccgtttccgcttgaaggccgtaaaaaacaccccggtctatagactcggggtgcggttaaagagagaagagccgtacagcgtcttcccgttataacccttccaagcctctctggactttctttaaaaggtttacatatgatttagtttttccgatgcaatcgcgtcttcttcatttgcatgcggcaggataaggttcaggatgactccgacgattgccgcaagcgccatgccggatatttggaacccgccttttgatacttgaataaaagcccctccgacgccgatcacgaggatgacggatgtgataattaaatttcgcttgttttcataatcaatgttgttgtcaatcagcattctcaagccgctggaggcaatgattccgaagagcaggaaggaaacgcctcccataaccgcggacggaacagagctgatcagcgctgaaactttgccgataaatccgaagcacagcgcaatcactcctgcgccgccgatgacaaagacgctgaaaactctcgtaattgccaggacaccgatgttttcgccgtatgttgtcgtcggcgggccgccgattaacgaagcgataatcgtcgctacgctgtcccccattatggagcggtgcagtcccggctttttaataaaatcctgtccgacgactttactcagcaccatttggtggccgatatgttctgacatcgtcacgaaagcgaccggcaccatcgcagcggcaatgcccaatgtcactgacggcgtgtagtctttgaaagggatgataaattcaggaacggcgaaccattttgcatcaatgaccggctgaaaattgacgatgccctgtgtcagcgcaaacagatatccgcctataatgccgatcaataccggaatcaagcttaaaaatcctcgtaaaaagatggcgcagataatggtgatggccaaagtgacgccggctacactgaaatgtttcaggctgtaaacgagttccttcgcattcggatcagcatacattgccatattgacggctgtgcttgccagtccgaggccgatgacgatgatgaccggcccgacgaccaccgggggcagcagcttcatcagccaccccgttccaagctgcctgatgagaagcgcgatcaggccgtacacaattcccgccaggaaagcgccgaccatggcagcccccggccctcccgtcgccttcaccaagataatcggtgatataaaggcgaatgatgagccgagataagcgggaatctggccttttgtcaccaagagataggcgagtgtcccgattccgctcgtgacaagcgccactgccgggctcattccgaccagtttcggcacgagtatggttgaaccgaacatggcgaataaatgctgcaggctgaatgacagccaggacaatggattggggacgtccctgactcccaggtttacttttttcttactcatggcgttttcctcccggttgactttcaaatggtataaaaaaacctctttgctttttgcgcaaagaggcatacaaagcccggccgtgtcgatccgcccggctttgtgttttaaaatcctctttgcaaactctctggaatgcatttaaaaagggtggttattcattttcgtaaatggcgaccatatcagtctgatcaacttcgctcagctgaaccatcactttttcagcttttgaggtcggaatgtttttcccgatatagtccgctctgatcggcagctcccggtgtcctctgtcgacaagcacggcaagctgtatcgatgacggccgcccgacatcaacgagagcatccatcgcagctctcaccgtccggccggtataaagcacatcatcaaccacaatgaccttttggtctgtgatatcggccggaatgtccgcgccttttacaagcggctcttcattgctcgttttttttgtgagatcgtcacggtaaagggtgatatcgatttccccgacggtgaccggatttccttcaatctgttcgatccgctcggccagccgcttcgctaaataaatacctcttgttttaatccctacaagaatgcagtcattcattcctttattccgttcgatcatttcatgggctatccttgtcagcgcccttctgatggcctgttcgtcgagaataacagctttttgattcaatcgtgacacctctccattcgtatataagaagaaaaaacccctcctgccagagcatagaggggttcctttccaggaccaagacacacgtgtatctcttctgtcctatccgttatccttctcagcctctctggactgtgttaaagaatctattcagcttgtttttattatttcagaaaagaaactcgctgtcaatggctatttctcaaatgttcaatgagttttttcatatcttcaggaaggggcgcttcaaactccatgtattcgcccgtccgcggatggtcaaaacctaatattccggcatgaagcgcctgaccgttgaaatcaatggtttttctcggtccgtacttcgggtcgcctgccaaaggaaatccgatatatttcatatgaacacggatctgatgcgttcttccggtttcaagacggcactctacgagcgtgaagtcttgaaaacgctcaagcacgtggaaatgcgtgacggcgtttttgctgctttctcttgttacggtcatgctttgtcggtcttttttatctctcccgatcggagcgtcaatcgttccgtcatcatgtgaaatcaacccgtggacaaccgctgtgtactttctcgtcacggttttattgacgagctgattaacgagtgattcatgcgccatatcgtttttggcgaccattaacaggccggaggtatctttatcaatccggtggacgattcccgggcgcatgacgccgttaatgcctgaaagatcgttgcagtgagccatcagtccgtttacgagcgtccctgtcacatggccgggcgccgggtgtacgaccatgccccgcggtttgttcacaaccaagacatcctggtcttcatagtaaatgtccaaatccatcggctctgcaagcacgtccaattcttccggttcaggaatggtgacgtttacctgatcgccgggctgcattttataattcgcttttacggatttgccgttaacggataccagtccctcttttacccattgctgcacttgagtgcgtgaccagttttctcccgttgaagccaaaaatttatcaatccgttcgctcttttgttcaggctgaacggttatctcaaattgattcatgttattgctccttctttttcccgctgtcaaacagcatatgaataaataaaagtattacaccgacgcacagtgaggagtccgcgatattaaaaatcggatagtgataatccacgatgatgacatgaataaaatccaccacttcctggcgcgccgcccggtcaataaagtttccggccgcacctcccagcattaagccgagagaaattccgagtaacatctgcccttttgcataacgctgtatgtaataaacgattccgataatcacggcgatggtaatgacgtagaaaaaccacatttggccggctaaaatcccccacgctgctcccgtgttgcgatgagatgtgatataaagcacctggtcgatgacaggtatgctttgtcccaattccatatggctgacgacaagccatttggtcaattggtcggcaataataataaaaagagcgataagataataaagcacacacgttcctccagtatacagttacttttatcctttatgaattttatcagtaaaagatgccggagtaaaggcagatcataagcgtatgcaaacagacgctgtcactcatacagcgcctgatcatatgcataatctccggttacccagtatggaagggttttcttttcaaattgagcgggataataaaaatcatcagcggttctggccgtcggcagcaccgcaagtttttcaatcggaatgggggcgcctgttttttcacaataaccgtacgtattgttttcaaacttagacagggcaagaagaacatcctgaagttcttcttttatatgatagatcagagttgcttcttggtcgttcattgaaggttcaacagatgctgacatttgaaagcaagaatattcgaataatcttgattgaagttcttctttcatcatgagaagctccgtgtggattgcggtcagttgatcattcattcatcacaactcctgctcttgatgttatagctttattgttgccctcagagcgctatttgaagcccataagaattttcctgccgttctaatcgatgacattgctggcatgtaaaaaagcgcccggctgacaccgggcgctttctcatttattatttttgataatatttttcaacgatttccgcattgcgcagtgataatgtcggatatttcggattggctccgacatctttagaaattacgcgggaacgctcacacatctggccttccgctttttctacggtcatttttcctgttgtaaagctttgcgcgttttccggcgcttcactttcgtcttttactgtcagttctgagacgataaacagctgcgcgatgttttctttaatggatgacaagaggtcgcggttttctttgttcggatacaaagtaaggctcgcttccaatgatcttccgataattttttcgttacgggctgtttccaaagctttcagcacgtcgtttcgaagctccatgaagcggtcgaatttttcttctgtcgcctgactgtccggaacagcaatggtttccggcatatctgtcagctgcacgctcgcttcttcaacaaatgataagtgagaccacatttcatccgccgtatgcgggagaatcggcgccgtcagtttcactaacgccagcagcgtttcataaaagacggtctgcatgctgcggcggtccggatgatccgcatgctcgatgtacacaacatcttttgcaaaatcaagatagaaggagctgagctcgatcgtacagaaattgtgaatgctgtgataaacaaccgcaaattcgtattcatcgtacgcttttttcaccttatcgatcagcttattcagcttgatcagcatatattgatccacttcgcggagatcttttacatccacggcattgatgcttggatcaaaatcgaacaggttgccgtgaaggaagcggaacgtgttgcggactttccggtatacttccgcgacctgcttcagaatatcttcagaaaccgggtgatcggcctgatagtttacggaagatacccataaacgcagaatttcagctccaagctgttttgcgatttttgtcgggtcaatcgtattgccgagtgatttactcattttacggccgtttgcatcaagtgtaaatccgtggcttaatacgcctttatacggcgctttgccggtgactgcaacagcggtggaaagagatgagttaaaccagccgcggtattggtcagagccttcaaggtataaatcagccggacggacaagatcatctcgttcttcaagaacggcctgatgggaagaacctgaatcaaaccatacatccataatgtcttgctctttcgtgaagattccgttcgggcttcccggatgtgtaaatccttccggcaggaggtcttttgcctctctttcaaaccatacgtttgagccgtgctgtttgaacagctcagacacgtgttcaatcgtttcgtcagtgatgatcggctcaccgttttctgcataaaataccgggatcggaacaccccagacgcgctgtcttgagatacaccagtcaccgcggtcgcgcaccatgttgtaaaggcgctgttcgccccactccggcacccacttcgtttgtttgatggcatcaagcagatcggatctgaaatctttaattgacgcaaaccattgcgcagtcgctctgaagatcgtcggttttttcgttctccagtcatgcggataggagtgtgtaataaactcgagtttcaaaagcgcgccgttttcttcaagcttctccgtgatcggtttattggctttatcgtaaaacattccttcaaagcccggcgcttcgtcggtcatgtttcctttttcatcaacagggcacagtacttctaagccgtacttttggccgacgataaagtcatcttccccgtggcccggggcagtatgaacacagcctgttccggcatcggttgtgacgtggtcaccgagcatgacgagtgaatctctgccgtacagcggatgttctgcagtgatgtattctaattctctgcctttatatgatgcgacaacttcaggattttcaaagccgcatgcctccgctacgttttcgatcagttcagccgccactacataacgcttgtctccaaccttgatgacattgtattcaagatcaggatgaacggaaattccgaggttggcaggcatcgtccacggcgtcgtcgtccagatgatgaagctttctccgttttccagaacgcctttaccgtctttcactttaaacgcaacataaatagacgcggaacgtttgtcctgatattcaatttccgcttctgctaaggcagattcacttgaaggcgaccagttgaccggcttcagacctttataaatatagcctcttttcgccatctcgccgaaaacgcggatctgctgcgcttcaaattcaggctgaagcgtaacatacgggttttcccaatcgcctctgacgccgagacgcttgaattgttcgcgctgtctttcgatctgctgccatgcataatcttcgcaaagcttgcggaaatcagcgacggacatttctttccggtttacttttttgtttttcgtcagcgccgtttcaatcggcagtccgtgcgtatcccagcccggcacgtacggtgcgttgtagccgctcattgatttatagcggacgatgaagtctttcaggattttgttcagggcatggcccatgtggatgtctccgtttgcataaggaggtccgtcatgcagcacgaatttcgggcggtctttcgtccgttcttgaacaagacggtaaatgtcctgctcctcccagtctttttgcatgtccggctcacgattcggcagatttccccgcatcggaaaatctgttttcggcattaacagcgtatctttgtaatccattttcattcctccacaacatttttcagaaaataaaaaaagccctctcatcccataagggacgagaaagcttatctcgcggtaccacccttttagaaaaaacggatcatccgtcttttcctctcgaacatcgtaacgtgatggaacgtcctttcctactctcggttcagaaaggaaactaaagggctgatctgcatgattccggccatcccgggctttcaccttccccggttcgctttatagcctgttttgagtcatgccggtccctttcaatcgtcttttcatctgaatttatgaacgtattatattcgaacgggccgaagaatgtcaagaaaatcagaaaattattctttttcctcaaataccgcgtcgacttcgtattccagcagatgatcccaatcatcgttcttcagcaggtcgagctgcgcttcaatcagcatttggaaacgtgttctgaagactttagactgttttttcagctcttcgatttccattgcgatttttcttgatttggaaagcgactcattgatgatgcgatcggcatttttttctgcttcacggacgatcagcttcgcttctttctgcgagttgcgctttacgtcttctgcggcttcctgggctacgagaattgatttattcagcgtttcttcgatattggcaaagtggccgattttttcgtccagctcgttcactttcgcctcaagctccgtttttttacggagtgcgatttcgtaatcttttctgacctgcattaaaaattcatttacttcatcttcatcatatccgcgaaaaccttttgtaaacgttttgttatggatatcattcggcgttaatggcatattgccacctccatttttacatttcagtacggttatctagttcacattataaaacaaatacggcacagatggagaaaaaaactgaaaaaacgactcatttttgccgttcaaatgtaactttccatttgtcttttttcgtttttccgtcaacttttgccaaactgcatcgtccgaagccgcgaatcgagagcatgtccccttcagcaacctgataagacggatcttcaatagctttccaattcaccttaacgagcccgtttttcacaagcgcctgcgctttctgccgggattgcctgctcattgaagcgcagacggcgtcgagacgcaatgaagaaaccgtgtcatcccttatttcgacatctgaagcgggaatgtgaagagcggaaagctcgattttctcaagctttaccggcgctttgcccgccttggtcagctgagtgctgacaaaatcggcgatttcaccggagacgatgagctgcacggcttcctctgagaaaatcagatcgccgtatttctgccgctttaagccgatccccattaatgatccgagaagagagcggtggtcaatgctgacgaatttttcagcgtattgaacgtcaaaagcccggagctcaaaatcatcctgttcaggttccatatattcagggtataaaatcgcgcgtttgcgctcagctctgtcatatcctccgaaaaacgcaagaccgcaggcgtcgccgataacggcttttacaatcacctgttccctgggatctaagaaatcagtcagcttcatccgatactggtccaggacaatctgtttccattcaagcacctgatcaataaaaggccgctcgtcttgtctgaagtgctggtaaatatcgctcatgttctttcctttctatgtaaagaggcttggctggtgccaagcccgtatcaaactgtcgcattcaagtatacattgcgatcatgcggtataggccccaaagtcccgtcgtggcaaaccgaagcacgataatcgctacaatcggggatatatccagcatggcaatgggcggaatgatccttctgaacggctctaaatacggttcgcaaatcgctgcgagaaaccgtccgaccgccgtttctctcgtactcggcacccatgacataaagatatagatgatcagggcaaacgagtagatgtaaattaaataactcagaacggaaaaaatttgataaagaatcatcctgctttaccacctctgatgttcgtcttcatttataagctccgaaatcgtgccggaaacgtcgacattatcaggcgtgcacagaaaaatatctgaaccgattctctgaatgtcgccgccgatggcgtagacggtaccgcttaaaaagtcgacgattcttttcgcctgatcatgctggatgcgctgcagattgacgacaaccgcccgcctgttctttaaatgatcggcgatttcctgcgcttccgcatatacacgcggttcactcaagaccactttagaggatttctgaacactttgcaagcttactacgttctgcttgccctgcggcttctgagcgtaagcaggctgtttatctttctgctgttcatgctcttcctgatgatcctgctccgtttcaatgtattcgtactcgtactcctcctcatccattgagaaaaagtttttcagtttatttttcatgctcatttgtttacaccccccggttcatttccgactaatgaagagccgattctgataaaagttgcgccctcttcaacagcgatttcataatcatttgacatgcccattgacagttcccggcacggcgcgtttgtctgattcagtttttgcacctgatccctcagatcacgcaattgccggaagcaggctctgatcgtttctgtatcgtctgtcaggggagccatcgtcatcaggccctctacagaaatgtttctaaactcagaaagctctctgataaaggggatgacctcctctgttttcaaaccgtgcttagacggctcaagcgaagtattcacctgcacaaaacagcgaaccgtatgctgcgcccgtttttcaatctcttttgccaatgacagtctgtctaaggaatgaatataagatacacggtcaacgacggccttcacctttctggactgaagactgccgataaagtgccacttcgggcttcctttgatgacttcctgcttatggataagctcggcatcccggttttctcccagacttgtaataccggcatcaacggcctcttgagccctttcagctgatacgtattttgtaaccgcgatgacggtaacatcttcggggcttcggcccgatctgttacatgcttcgtttattctttcgtttatatgtcgtaattgatcagcaacacgcaagatctaatgcctccttcattccgataaaggacatcatgcgtcccgttttccctttgtcgcggcggtgtgaaaagaatagttcatgctctcgttcggtgcataatccgctgactgaaatgttttcttccggaatgccgcaatgtatcagaagaagacggttgacctcttttaaatcaagctgatactggcctttttccgtttcgcatatggcggattcagccgtaaagggcagcgcccgcacttcattgatgacgcggtcgtcgactgtatagcttcccgcgctgatggacgaaccgatgacagcctgaatatctgttaaacgggagccttcttcgtttacccagcgttccgtcatgatgcgtccgatttgtttgaccgtccccttccatccggcatgggcagcgccgataatggatttcaccgggtcataaaaatacaagggcacacagtccgcaaaacaaagggccaaaaaaagattcgcatctttcgtgtagagcccgtccgtcccgcggaatgcggaagaatagtctctcgctccttttcctttatccccggctgtcacgcgccggacgcggttttcatgtgtctggtcggcgaacacccaggaatccagatcagtaccgcataaggacgctatgacttcacggtttgtcacaacatcatgagcttcgtcccggacgtgcaacccggtatttaatgactcatacggaggattgctgacaccgccgtttttcgttgtgaatccggcgatgacctttgtgttaagctgattcacacagttccagtcttctatcatgagtgccgaggggtggtaagactaaacgggtgatatgtattcatggagatccaacctttcgacaaacattaaaaaagcgtaatttcccactcattttaacacaattttaagcatacgtttagcggctgattgaaaaatgagataaataaatgtgccggaaacattgagatttccggctttttacaagtaaagggaggattacgctccccctttggttcatttacacgcactaagatgacatcttccccaattttaactatatttcgccaaggaatgatcatttcctcttcttttccgaaaaaaccgagaacttttccgctgccgcctaaaataatcgcctgaatttttcccgttgtcacgttaatatcaatatccccgatgcttccgagtttttttccgttcgacacgtttaccacatcttttatttgaaattcagatatgctgatcatccgtatcacgccctttgcccgttctttttcctattatatgaacggccgggctgaaccttgtcacatcgggcaatcttttttgcggctgcaccagccgagaataaatctcagcatgattttcgtatagtccataagctcatcaacggacacttcctcgtttacggagtgggcgttttttaaatcgccggggccgtatatgacgctcggaatcccggcctgataaagccatcctccgtctgttacggtttgggaaacatcaatgacgggctcctgttttatgacggcagagtgtgatgcagccaagacagaaactgccggatgatccggatcgatttccagcgccgggaacacctctcctctgtcttcaatcatcgaagatccgccccatttgaacaccggcctgttttctttgagccacagatcactgtcagcgacacgattaatatagtcttcgatttctgcggctgcttgttcgtgcgtttcgttcggataaaagtggacggtgatccataaccggcattcatcggcgacaaacgctgcgtgtcttccgccttcaatgacggcggggttgatcgtattggtgccgggcgcaatgccgggatagcttttcgttaccgcccagtggcgctccagctctcccaaggcagtgatgattttcgccattttttcgatggcgctcgctccgaatgtgcctccgcccgcatgaatcatattgcgcctcatgccgtcatgaaatgtttgtttgcttttcaattctatccagccggtgatgacaccgccctgcccttgaatatgcaggctgctcgtatccgcgacaaccgcaaaatccgcgtgatagccgcgtttgcagcattccagcgtccccgcctcgccgacttcttctccgattacagactgtacaatgaggtcgcccggaagcttaattgcggcatcatggatcagcttcagagagaaaagaacacacgccaacccccctttcatatcagcggcgccccttccgatcagcatgccgtcttttacgagcggctgaaacgggtcagagttccaatcttcgcccccggcttctgccacatcaatgtgtccgtttaaaatcaggctttgatgcctgcttgaatctgtcccttttaaaacaccgactacattcggatcttccggatacacatcccacatatcgaccgagcagcccgtttcttttaaaaagccggccacccacttttgggcttctgccgtatttcttgctggcggggccggagtgggaaaggcgatcaacctttcagcaatatgtatgaagtcgtgcctccgtttctccgcctgttgtaacagcatatcaatctgatgcattggaaatctcccctttagctgtatcaaaaaacccgtttcattaaaatgaaacgggtaaaaaacggatcttcctccgcttttttcaccgcttccctccgccggcatgatccggatcaggtccgttaagggttgagacaacgtctctctcagccgcatggcagcacccccagggtgaattgatgttattttacggttgatgcctcttttgcacgtgttaaaaacgggcggccattgttccataagacattgacaggcgtatcgaaaaacgctgtaagccgctcgtcagaaagcatatccctgattttcccggaggcgaacacctcgccttgttttaaaagcagcgccttatcaaataccggcagaatttcttcagcgtgatgggtgacataaaggatggacggcgcattttctttttcggcgatcgacgtaatcgtgtccagcagctgctcccttgccataaaatcaagacccgtcacgggctcgtccaaaatcagcagtttgggatcagccataagcgcccgcgcaatcagcgctctttgtctttccccttgtgataatgtttcataccgcctgtcggcgtaactgatggcgcccaaatccttcagaagaccgatcgctttttcccttacctgctcactcggagtttcgtacagcccgattgaggcgtacgcgccgctgagggcgatttcaaaagcggagtccgcggcatataatttgtgctgaagacctgccgaaacaaggccgattttccttctgagcctgtcaccgagctctgttttgccgaactgatggccgagcacctgcatctctcctgaagtggggaagtaataagagcataacatattcagcaaagccgtttttccggctccgtttaatccgtacagcacccaattttcgtttttctcgacgcgccagttaatatctttcaaaatccatttcccgtttctttttaatgacacactgtccagctgtaaaatcattgccgtttcccccgtttactttatttaaattttctaaaaacttttacacattagaatacatcacttttttgcaaacgtaaaccatcgcatgaaaaaagcctttaaacaaggtttaaaggctttttccgttattgatggatattcttattcatttgtttaatggctgccttttcaagccttgagacctgagcttgggatatcccgatttcttcagcgacctccatttgggttttcccttggaaaaagcgctttcgcaaaatcattttttcccgttcgttcagtcttctcatgccttctttcagagccagctcctcaatccattgtgtatccttgttgcgctcatcgctgatctggtccatcacgtagatcggatcgccgccgtcattataaatcggctcaaacagtgaaaccggatcctggatggcgtcaagggcaaacacaatttcttcatggggcacttcaagaactttggcgatttcctctgctgtcggctccctgcttgtctcactgattaaccgctctcttacttgaagcgctttatatgcgatatcgcgaagcgacctcgagacgcggatcggattgttatcccgcaaatatctgcggatttctccgatgatcatcggtacagcgtatgttgaaaacttaacattatggcttaggtcaaaattatcaatggatttcattagtccgatgcagccgacctgaaataagtcatcaacatactctcctctgttgttaaacctctgaatgacgcttaagacaaggcgcagattgccgtttacaagcttttccctcgctgaatcatcgccctcatcctgcaattgcctaaacagctttctcatctcttcattcttgagcaccggtaatttggaggtatccaccccgcaaatttcgactttatttcttgacacgtttttccctcccactaggagctgctgtacaacgttaagtatctcctcgggtgggaaaaatatgcaccgctattttacagaaataaacatccggcggcggcaatccttgcagcagtaagggctgtcagatggaaaaaattttacaccattttgttaaactcttttctcagtcttttgataatccgcttttcgagccgggagatataagattgtgaaatccccatcatgtcggctacatctttttgggttttttcttcttctccgacaagcccgaaacgcagttccataatctgcttttctctttcgtttaattgctcaagcgcttttttcaaaagttttttatccacattggcttcaatgtctttcgtaataatatcatcatctgtgccgagcacatccgaaagcagcagttcgtttccgtcccaatcaatgttcagcggttcatcaaaggacacctctgaacggattttattgtttcggcgcaagtacattaaaatttcgttttcaatacatcgcgatgcgtaggtggcgagtttgattttcttttccggattaaacgtgtttaccgctttgatcaaaccgatggtgccgatgctgattaagtcctcgatattgatgccggtgttttcgaatttgcgggcaatgtaaacgacaagacgtaagtttctctcaatcaggatggcccgcgccgcctgatccccgctcggcagctttaataagagcacctgctcctcttctttagacaaaggcggcggcagcgcctcgcttcctcctatgtaatacacttcatcgcttttcagtccgagtttcatcagccatttataccacaaatatgtcagacgcagcttaagttttttcatcttcctcccccttctaaataccacgcgttttgagtatgatgaataacagacttttcgtcaggaaacatgttttacagccttccctgtcagcatcttcggatgaacgattccgtcaaattcaccgtcagcggataatggcttcgtgctgatgccgatcaggcatttttcacatgcgatcatctcgtcttttgttaaaatcgtgacgtaatccggctttaaacagagtaaaaattgattgtcctggccgacgcccctgtatggaatcagcctcagcttatccgcatggcggaacgaatcatcaagctgctctatcacttcaagcggactggcggatttgatgaagtccgtttccttttcgctgaggatcggagcgaatttgttaatgtgaaggatcatgaccggcgttttcgtcagcggatcatacagctgattcccggaatccaccaatcctttcgcgcggattgtctgtccgctgaattccgcctgcaccatgacaagttcatcgtactgaatggacttcgtctcgatgtcttcaattctctttttcgaaaaaaaccatatggccggaaatccgataactacaaacatccagctgatcgggtcgccgaatccggtctggcttgtaaccattacgccttgctgcacaattgattctgtctgcagcagggaatgtacgccgatcattcccccgccgacgagaaaagtcgcgaaataaaaggcgaacaaattttgaaaaaagtatcggaaccgtttaaagccaaaagccgtaagcacgatgactaccgaaaacgccatttttcccgccggatgctccacaaagggagaaataggcgtaaacatcagaagcacaatggctgacccgatgaaaccgccggcggccactcttctttttttcacctggcgttttaaaataaaggcggtcaataaaagcaaaagagaatcaaaacaaaagttcaacagccaaatgacatccagatagattttcacatctgacccctttcctcttttgtcttacatatctgtttctctctcttgtttcataagtataaagcaagctctgtgggaaagtctgtcaattaatgttgagggtaaagtacaatttttaagggataaccgttttatttgtcgagggccgaaaaggttgattttctattgtccccttcaactaaaaaagcgctgccgtgatttggcagcgctctgtttttactcattgatataaagttttcctttagccgtctgtctcgtttcatttccgtagtcatctcttgcgataacgtcaatttttgctccgcttgctttgatggaagaagccgccgtccagtaaccctcatatcgtcccggagaaatttctctcagcggaagctctgttgcgttttggctccctgcccgggcgtttgtcagaggcagacggatcacgaaggaagcgtctaatttctttccgcttgaaaaagcgattttcactgattctccggcttttaattccttatccgctccgggaaccaatccggaaatgacgggagcattgtaattgacatcgattaccgtctttttcgttgttttgttaccagcttcatctgaggccgtgaccttgatctcattgctgccgttttccagaagggttctcgcttgataagaaccgttatttacttcagctttttttccgttcacctttacccattttaaatgggcgtcgtgcacttttccttttacagtcactgcttctttatttgttttatcaccgtttgccggactgtcaatcgtcacatcaggcttatcctcatccagtatgaccgtgacagggcgtgactcgtcggttgacccgctgtctgtcacagatgccgctgtcagccgattgccatctttagtgagtgtgacaccggcctggaaactgccgtctgcatctgctttcgtttctgcggcggttttaccgttattggtaagacggacagcggtttttggtgaagccgttcctttcaccgtgattgacttcttgtttgtaaatgaccggttttcaggcgacgttatctcaggcacagaagcttcgtagtcgaccaaagccctgatcataaagtttccgtctgttttatcggcttttgaccagcggccgtcgaggtattgccagtttctgttcgagtacgggctgccgtcatcagatgacagggcaggtgtataaggatcgggtttcgtctgacggaacacaagataaaaatcctttccgaccgcgattccttttgagctgagatccactttggtccactcgccgtttcgaagcgcttcagcttggaacgggccggcaattttgctgcccggagctccatcagggccggatgcatcatatacttctgcttgaaattcggtaccgcccggatcaggccagtcggcgccccaaaatttaaaaaggcctcccgtcagcataccgtgttcttttccgtctttgagggtcatcttaacggcagatttgctgccggctttaaaatatgacagcgcggcttcttccgtcccgttatcataggcgatttccccttcataaccgacatacggcttaagcttgacgtttttttcagcatctcctttgatgtcgacagaaaattcgctattgtaaaagccttttgccgctactttgattgtgtaggagccttcatacgccttaagcgaatattcccctttatcgtttgtcaccgccggctcaattgcggcatcctcggccacataaagcgcagccccttttaccggttcgcctgtggactgattggtgatggttccttttagcgtgccggacggcatttgctccagtgtaaagtctgcctgtgcggttttgtctgattgaatagaaacttgtttcgaagcggacttaaatccgtaagcctcggctttcagcgtatagcttcccgccttatgtgacaggctgtaacttccgcttgcagggtcggaatatacggatttccccgtctcggcgacactgatttgcgctctgagcggcaggaggtttgtttcacgtttcactctttttccgggtgatttcactgccggtttggcctgtttcggactgatggcttttttcttcaggtggccgggaggtgtttgtctattgtgtttactttttttagccgccttgccgagagggctgcttgaaagccggatatcatcgatataccatccgtcttcattgagtacttcgtcagactgcatattaaacatgagctttatgttttggcctttatacgcagataaatccgcctcttcatcattccatcctgcggaatcaccattgtaaacggccgcctgctcccaatttgatttcccttccggcagaacgaacacatacccgtaatcaaaaaattcttcgagcttgtgccagcttttaaattgtaaaaacagccgccctgtttccggaacttgaatcggaggcatcacgagattcatgttggccgaatcggcataagggccggacagattcgtcgcatacactttatctccggaaaatgcggcgccgggccctgaacccgggataccccattcccattgatcatgtgtcccgtaactggaccagcccgccggctgtgattcaaaatcctctttgtatcccgccgtaatgctcggtttcacgtcagcccggtacgtatcagattctacagaatgacctccgaaatcttttatggtccatttataacttatcttgcttcccgttatgtccggaatctccgcctggtatgttccctttttttcatcaccgcttttttgaacggcggctgtcgttttccactctccttcatcaaactgataggagaggatcacctcagttatgcttacatcatcttctgctgtaaccgttaacggaaggtttgcccctttgtaagcctctgagaccggttcatgatgaaagctgggcggattgtgatcttcacccgcagaagataccttgccttctacgcttccgattccgtccgttacggcagaaacggcatcaaaagcgttaacgaggccgtggccgtaaccgttattcggtgattccggaaaaacggaatctgtcagcttttcggcggtgcgcgtcagaacgtcttccatttcatcgaccgtaatagaggcgttcgcctgccttaacaaagccgccgtcgccgccacatgcggcccggccattgaagttccgtcccagccgccttcgtatgttcctccaggaatagaagaacggatattcacgcccggagccgaaatgtccggttttgtttcatgatacggtgagggccttgaagtgagaaatcagcgagtttcttgtcgatgtcagtcgcacctgtcgcaaatgcttcaggataattggccggatttgcgattgaacccggtcctcccggtgtaaataagtcttcatttcccgcagagaattccggaaaaatccctgccgctctccacgcattcaccatatcgcggtaccactcgtccattcccgaaccgcccgcccaggaattattgacaacatccggcgccatctcgggatgcggcgtgccgtttttatctttaggcgcaagcacccattcaccggcatccaaaatatcggcatcggttcctccgtcatctgaaaatgcttttactgcgatccatttcgcccccggagccacaccgatttgatttgagccgtcaggttctgaacccgtcatggtccctgttacatgagtgccgtgttcaagatcgtcgtagggagcgtctttatgggacacggcatcataccagttcatttcatgattcggcgctgctggattttcaggatcgtaaccccggtatttttccttaagcgcgggatgatcccactgaactcccgtatcaatggaggcgacaaccgtgccggttccgtcgtatcctgaggcccaggcctgcggcgcatcaatttggctgatattccattcgatgccttcctttgctttgacctctttttgttttttcttcatttgaaaaggagcttttgattgccgttgagtaagctgacgtttttcattcggaagaactttttctacttcaggaaatgaggcggctttttccattacctctttcgaagcagtaactgccattccgttgacaatataataggaatggatgtgatcagcctttcctttctttttttgtttttccaaatatgttttcagattctgctgcgcatcatgagctgccagttttaaagaagaaacaacggctgaccgcttttgatattcggtttttgctgcggaaagcgaatgagactcggcatttttttctgcttctttgaccgcttttttcgtattggctttctctttaaatttgataagaaacgtgactttatcatttttttcaaaacgcttcttgactgaatcggaaatcttatgctgaatgctcttagaggaagaaagatctttggtaaaagaaactgcccccggtgtgctgttcgctccgactgcccccggaaacaacagtgaactgacgacaatcgcgcttaaaacggagcctgtccatctgtttctcgtttttttcttcaatcgtatccccccttatttggtaacgccctataaaatgtgtatccctccttcataattggaatcgtttgtcatttcgatgctgtacgttaaatgtagacaatcttccatccagatattgtcacattctgtagaaagccgtatgaaacttaaaaacaatcaattcgtcataggtataaagcttcttttttcactgtatagatcatgggggataggaaggaagactgtgcacaaaaaagaaaaaggacaaaaccatgtggtcttgtccttttttacatcagccgcgtttgttgcggtttcttaaaaatgtaggaatgtcgagggcatcatccgccggttgtgatgtatggcggttcaccgtgttttgatgctgtgtttcttctcgtttcggctcacgtttcgcagcattttggctttgagacttcaatccttggtttaaagtcggacgctgcggttttgagtcatctttttcctgttcgataaaaccggtcgcaataacggtgacgacgatttcatcttttagattttcattgataactgaaccgaaaatcatattgacatcagggtcagatgcagaagcgacgatgtcggctgcttcctgcacttcgtagaggctcaggtttgtacctcccgtaatgttcatcaaaacaccttgcgctccgtcgattgccgcttccagtaacggactggagatcgcctttttggcggcttcagcagcacggctttctcctgtagcgatcccgatacccatcaatgctgaacctttgttggacatgatggttttgacatcggcaaagtccaagttgattaaaccaggcgttgcgatgaggtcagagataccttgcaccccttggcgaagcacgttatcagcttcacggaatgcttcaagcatcggtgtgtttttatcgacaatttcaagaatgcggtcattcggaataacgatcagtgtgtcaacggcttctttcattgccgtgataccgcctgcagcctgcagctggcgttttcttccttcaaatgtaaacggtcttgttacgacaccgacagtcaaagcgcctaagtcctttgcgatttgcgcgatcaccggtgcggctcccgttccggtaccgcctcccattccggctgtaacgaacaccatgtcagcgccttttaacgcttcttcgatttgttccttactttcttcagcggcttttttgccgacttcgggattcgctcccgctccgagaccgcgggtcagcttttccccgatctgcattttcacttccgcttttgacaggttaagagcttgcgcgtccgtgtttaccgcaatgtactctacaccctgcacttcattttcaatcattcggttgaccgcgttattaccgccgcctcctactccgattactttaattgatgctaagccgtctatgtttgtttcgaaatccaacatgctaaatcctcctaatctgccgaatgactatcaatctattcccaaaacatgcttaatagttttttcattttgctcggtttgttgtgttcggcttgtgttttttgttttgcttttggacgctgctgcgcctctggccgctgatgatgttcttcttcgtgagagaccgcgatttcctgcacggcttcttccggcatatgaaagcctatttttcttccctgaattctggcatttcggcaggcaaattgtatcaagccgacacccgtcatatactgagggtctcttacaccgatataattcgggcttgcgacccttacattgtgcctcagcacttcctgtgccaatgaaagcactccgggcattgcggcctgtccgccggtcagcacaaagccgccgggcagatctgtaattcccatatgctcaatttcggctgcggcaatctcaagaatctcttccactcttgcttcaataatattggcaatttcctgctgtgtaaaagattgcttttgattcgttcctatgacggtgacttcaaatacttcatcttctgaagcctcatcgtagaatgcatgtccgaattgtttttttactctttcagcctcttcggtggaagtgcgcaatccgatcgatacatctttcgtgatgttttcgcctccgagcggaatgacggctgtctccttcaggtgccctgttcaaataccgccaccgtcgtcgagccgccgccgatatcaatcatggcgactccgaggtttttttcgtcttttgacaaagccgccgaaccggccgcaagcggctgcaggcagatatcagtaatttcaacgcccgctctctccacacagcgaagtaaattatgtaagatcgttttggagccggtaatcagcgtgccttctacttccaggcgcactccgagcatttttttcggatcggtaatttcgtctcttccgtcaacgataaactgtttcggaacgacgtcaacgatcagctgctcatgcggaaccgacacaacctgtgccgcttccattaccctgcggacgtcttcaacgtgaatttctttgttttcactggaaacagcgacaacgccgttcgtatcttgaatatgaatataatttccattaacgccgacaatggcttttttcagcggaaaacctaccattctttcagcttggtcaaacgcttttcttatagaatgaacggtttcatctatatcaacgattgagccttttttcaacccttcagacggtacatttcccactccgataatgttaagggaatcatctgtcatttctccgacgatcacttttgtattggacgtaccgatgtcaagactgacgtaaagttcattgttgttcattctatggcacctcctcacatttcgatcaaattctattctattatttgcggaacaacaatacaatgaatgtggctttacaagtgtgtaacaaaaacaacagcatcaacaaattcttatctgatttctcacaatttatgtttaatgaaactattcgttatattctatgtatatcctcttttatatcgcattttttttattttttttagagacggcccaccttaccgtaagatttcctgtcacggtgccataatgtgcaaaccagatgcaaatatacccgctttccattagtctacactaagatgaacctccagaaaagctatagatattgccagaaacatccgaaaaaagaagaaacaggaggaaaattccaaatgcaatgttcattgaagaagacacgcccattgcattgagaattttccccttgtccggcagccatatcccgggcaaaaacaaacatagtcataattattccgctatcggttatatcggctgccccgctgattgtaatagattcttttgaatcaccttaaaattagttctttagaactattaatcattttcttttttcttgccggatttacctttgttaaattcttcaaaatacgtagcgacttctaagtggataatcccctttttcccgccgtccagctgggaaacgatagaaggataggtcttcatccggtcggcaaatgttttaatagaagcggtaactacatacccgtcgttcatatacagcttgatccggtcctggtccatttttaccggtgtataatagatttcagaaatcgactgctttagcgaaccggaaagcttatcaagctgctccgccattttgacccgctttttcgcgtttgtccagtcaaccaaaatcgggcccgcgtcatccggcgtgacttcgttcggcagcacggtgccgttctccagcacttcataatacacatcattccgctgcagatacgcgatcgtcttgtattcttcaatgtgaatgctgactttattaggaaatacttttgaaagatccgcctttttcaccagtttattctgctcaatcttttcttctgtttttttcttgttcagactccagaactcggtttgtccgttatgtatatcagaaagcgcgttgatctcttttacagacacgttttcgttcccggaaacggtgacagaagacactttgctgatcggcatctgcaagtacacgatgatcagcaccatcataaaaaagagcacaatgaatgaaatcagccggcggtttgctttttgtttccgctgctctttgattttcggaatccgctcttcaatatttacgattttttctctttcatgatttgggttcactgcctgtccacctcactaagaatgaaacagcttgacattcgtctgattgaaaaacaaacggcatgctgtgatgccgtttgacatttgttaaaagtatatcacatgagctcatggaaatcagagaaccttttaacgattccctccgatgatttcaacttccgtatgcatgtcaacatcatactgctcacggattgtctttttcacatactcaatcaggtcgagaacgtccttggcagtcgctccgccggcattgacgataaaattcccgtgcatttcggatactttcgctccgccgatctgatgtccttttaatcccgctttttcaacgaggtttccggcatgattcggcagcggatttctgaatatgcttccggcgcatgggcttgaatacggctgcgtattttttctgtaatctttgttctgctgcatttgcgccgtaatggcttcccgttccttttgctcaagctgaagaactgcctcgagacagacgccggggcgttttttctgcaaaacagacgttctgtagctgaaatccatctcttcgtttgtcagccattcgattgtgccgtcttcaaataagatacgcgctttcacaagaatttcactcatatcagatccgtgcgccccggcattcatatagacggccccgccgattgatccggggatgcccgctgcaaattcgagaccggacattccttttttactcatggaagtcgcaagccggacgaccgaatagccgcctccgaccgtcacctgatcaccgtcaatctccaaatgatccagacccgcgcccagtttgatgacaactcctcttatgccttcatcaagcacgagcagatttgaaccccggccgataaccgtccatggcagatcatgtttcttcacaatatccataatatctttgaccgcttccacactgttggggatgatcaaaatgtccgccgggccgccgattttcatcgttgtatggttcgcgagcggttcttgttccagcactttgccgacttcgcggtctcttaattcctgaattacgttctccatcataaacctccgcattccatttgctctatttttttatgtcttccatgatactgtacagtctggctgccgcatccggaacaccgagtgattttgtccgctcactcatgtcttttaaggtttcttcattcatgacgattttgtccagcgcagcgatcagtttttctccgctgagctcggtttccttcagtacgattgcagcgtcatgctggctgagcgccttcgcattgacttcctggtgattggctgtcacatacgggctcggaataagcacgctcggaatgccgagagcggtgatctccgcaatcgtcgtcgctccggctcttgccacaatgacatcaattgattgtaagtactccggcatttggtgcaaaaacggttttgtcaccatattatcagcggcttttccgcctttcagctcagccgttaccttctcgtaatgcacttccccggtaatataaagcacttggtaaggtctcgttttcaattcttcctgcatatctatcacggcacggttaatgggagccgcgcctctgcttccgccgaaaatgagcaccgttttttgattgtctttcagcccgaactcagttaatgagcggcctgtcttaattgagacgacttcagaggctctcgggtttcccgtaaacacaactttttcagcaggaaaatgcgattttgcttcttcaaagcaaattgccaccttattaacatatttcgagagaaacttatttgtgatgccgggcaggctgttttgctcatgaatgatcgtcggaattcccatttttgccgccgcgtatacgaccggaccgcatacatagccgcctgtaccgataacggcatccggtttaaactcttttaaatatgatttgcttttcttcacgccttttaagaaacgcatgacggtttttacattttcaaaagaaagttttcgtttgaaacctgtaatttcaatggcgcggaacgggatattttcccgttcaacaatttttttctccagaccgttctctgttccgatatacaaaaattccacatccggatgccggcgctgaacttctttaataaaggccagggccggataaatatgtcctccggttccgcctccgcttactgcaatacgcattcgtatgtcccccttaatcacatagcgataaccctgttttttaggacagggttattgatgttgtctgtttttttatagataacgaatagatcatgagtgatgaggcaagatacagatcaatacctcgagtaccggctgacatttaaaagcacgccgaccgctgcgagcatcagcgtcagtgatgagcctccgtagcttaaaaacggcagcgtaattcctgttaccgggatcagccccgtcacaacgccgatattaatcatgacttgaatagctatcatagaaataataccgatggcgacaaagcttccgtataaatccggcgcgccgagggcaatcctgacgccccgccacaataaaatactgaacagcagcaatatgagcgaaccgccgataaagccgagttcctcagataaaatagcaaaaatgaaatcggtttgcggctccggcaggtaaaaaaacttttgccggctttggccgagccccatcccgaacagtccccccggacctacggcatagagcgactgaatgatctgaaatccgcttccaagcgggtcctcccacgggtttaagtaagaggtaatccgtttaatccgataaggagcggacagaacaagcgccgcaaatccgcttaaaccgatgagtccgaggaacgcaaaatgagcgattcgcgcaccggatacaaaaatcatcacgatgcacgtgcccaccattaccgtccccgttcccaggtccggctggcacataataataataaatgcagaaaacacgattccgagcgcgggaacgaatccgcgtctgaatgacgtaatattcttctgtttttcagaaagaaatttagccagaaacgcaatcatcgcgagtttcataaactccgaaggctgaatgctgaacgctcccactccgatccagcttcttgaaccgttccgcaccattccgactcccggaatcagcacaagcacaagcagaaaaaaacaaatgatcagaagcagcttcgaccatgtgcgccatgtccaataatccacattcataatgaaaaacatggcaatgacgccgatccccgcaaacagcagctgccgtttcgcgaagaaaaacgagtcgtcaaatttataatccgcccataccgcacttgcactgtagaccataattaatcctattgttaaaagcaataacgtaatgataactaataacaaatcaggcgctgtttttttagtagtcaaagcaatcgacaccccaagcataagtcatttagggctgccgatgaacagagacaagcccttacttaagcatatgcacggcatctataaacatgtcaccgcgttcttcaaatgttttgaactgatcccagcttgcacacgcgggtgacaagaggatgacgtctccttcatttgagagcgcaaacgccgcagatactgcttgttcaacattatcgacacgtttgacatgttgtattcccagctcattgcccagtttttctatcttcggcgctgtctgtccgaacgtcaggaccgctttgacattgtccatatacggtttcagatcgtcaaaaccgttgccgcggtccagtccgcctgcaagcagaataaccggtgctttgaacgcggagagcgctttgcttgtggccaaaatattcgtcgctttgctgtcattataaaatttacgattccggattgctgttacatactgcagacggtgtttgacaccggtaaagcttgtcagcaccttctgaatcgctttattagacgcgcccgccgtttttgccgcggctacagcggccaatatattttctaaattgtgcgcgcccggcagcacgatgtcatcaacaggcagaatcgcttcatcgccgaacatcagcattccgtctttaataaatgcgccgcttgacagttcctggtgcactgaaaacggaacggtgccggcttttccgctttcggcaagccgcacgactgtttcatcgctttgattcacgatggccgtatcactctcaagctgatgaagatacacgttctgcttggctttttcatagttttcacggctgtgatggtaatccaaatgagcgtcgaacacatttaaaatcaggccgatttcaggtctgaacgcatgagtccccataagctggaacgaagaaagctctgtgacgatccattcatcaccgtcagcatgataagccacttcactggcgacagtgccgatatttcctgcgatcagcgcctttatcgagtcagctttcagcatttcataaatcagggtcgtcgttgttgttttcccgtttgaacctgtaatgccgatgaattttgcattggtgatataatacgcaagctcgatttccgtccaaaccgggatgcctcttctttgcgcttcctccaccatgatattttcatacgggattccgggatttttgatcagaatggtaatgtgatgctgatcaaaaagtgacgtcggatgctcaccgcagatgacctcgattcctctttctgaaagcctttgggcaggttcgttctcttcaaaggctttttgatcattcacgacgacgttaatgcctttttcatgaagaatcgacgcagccgcatatccgcttttcgccagtccgaggaccagaaagttttgttttcgcaaaaaaagttcgttttccacttataaccacacctcgatgtaaattcctaaaacggcaagcagcagtcccgcagtccagaatgtgacgacaactctccattcagaccatccgaccaattcgtaatggtggtgaagcggactcatcttaaagattcgttttcctgtcgttttaaagctgatgacttgtaagataacagataaggtctcaataacaaaaactccgccgataatgacgagcagaatttcaagcttcgtcagaatggcaacggtcacgatcgctcctccgagcgcaagcgaaccggtatcccccataaatactttggcgggatgggcgttgaatacaagaaaaccgagaacggcgccgacaacggcaaccgagaaaatcgcaacgtcatattgtgactggttccacgcaaggatggcgaaagcgccgaatgcgatagccgcggtaccggacaagagaccgtccagaccgtctgtcaggttgacggcatttgaacctccgacaagcataaagagaacgaggataaagtatccccagccgagatcgattgacagatgtgtgcccggcaccctgatgccggttgaaaaatggcaataatgatatactccgtaaaatacaatggcaataatgatctggccgatcaatttctgcttcgacgtcaatccgagattccgtttcattactactttaatatagtcatccagaaagccgagcaggccgtatccgatcgtaacaaacagcagaagaaacatttccgcgctcagatgcgaaaatttctgcgtcatgacaatcgccgtaatagcgatggatacgataatcatgaccccgcccatcgtcggcgtccctgattttttcatatgtgatttcggcccctcttccctgatactttggccgaattttaaacgtcttaaaaacgggataagaatcggagatatcagaacactgattaaaaatcccattattattgtaaataaaatcacttgctcaagcattgctcttttctcctcccgtttcgttcaaacgacatacgtatttatcatattcacattgtgtccccgtaattcttttcatttcactcattctaacactctttcctgttttactttttattcagctcaacaatagctcttcccgctacttcggcgtcatcaaagtcgaatgtttcattgccgatctgctgataggtttcatgccctttcccggcaatcagaaccacatctccctttttcgcgttggcaatagcaaaaaagatagcctgctcgcggtttgcgatactgtgatagtaggtgccttctacccctctttccatatctcttaatatggccagcgggtcctcgcttctcgggttatctgaagtgaaaatcggttcgtcggcaatccgcaccgcaatttccgccattttcgggcgtttcgttttatcccggtctccgccgcagccgacgacgacgaaaagcttgccctctgtcatgtctttgcatgtattcagaacgttttccagactgtcaggcgtgtgcgcgtaatcgacgaccacaggaaacggctgattatgattcaccagttcaaaccggcctctgacaccttgcagctcttcaagagcgctcgtgatcgtatcaaacggcagacccgctgcgatcgctgtcgccgctgcagccagtacgttatacacgttgaagcggccgacgagtgaaaccgtgatctgctttgttccttttggcgtaacgagttcaaaatttgtgccttgcgcagagatctcgatttgtttcgccatgacatcggcatcgttctcgattccgtatgtaaggatgtgcgccgccgtcactttttcaaaataagcactggctttgtcatctgcgtttaaaacggcccgcttcggcttttcatggttaaaggagccgcccagctgggaaaacaggaggcttttagcctgtctgtagtcttccatcgtcttgtgatagtctaaatggtcctgcgtcaggttcgtgaatacggcgatatcataatcgcagccgtgaaccctgccgagtgacagagcgtgagaagacacttccataatagctgtgtcaacatgctcatcattcattttcttgaacgttttttgcagtgtgacgctttcgggcgttgtatttttgaccgggaatgtctcatccccgattttaatgtacatcgttccgattaaaccggtctgtcttcccgcttttttgaaaatctcatcaaccatgtgcgtcgttgatgttttgccgtttgtgccggtgatgccgataagctgaagctgctttgtcggctgcccgtaaaacgcgtcagaaagaacgctgagcgcccgctgtgaccggcggacgataatgacaggaacatcgacgtcaagctctttctcggcaacgatggccgctgcgccgttttctgcggctttttgggcgaaatcatgtccgtctaccgtatacccttttatacacacaaaaagactcccttttctcacttccctggagtccatctcaattgaagttatgtcagggtcatgaaagtcattttgaacaggttcggccattaaatatgtaagcagctttgtaagtttcattgtatcaaacctctcagaaattctattcattcttttatcatgataaccgtttataaaagtcagaatggcttttaaacatacagttcatattttagcgtaaataaaaggatacatccagttaatcttaaaagttatcttctttttttctctttatgataaaaggcagccgaaaacaatcggctgcctcaaaaagactcattcttcactcaagtaaacacggatctttgagccttcttttactttcgttccggctgcaggtgattgtttcacaattttgcttccttttcctgaggagtcaatattcaaattgacaagcagcgactcaagatcagagacagacatccctacaacattcggaacctctattgtttttgtgtcgttccattgatattttttctcgatttgattttttcgcggtttcacgccgagctccggcagactgtctctcatcatatttccgacaatcggcgcggcgacggttcccccgaattgaatcgtgcctttcggattatcaaccgcgacatacacgacgaggctcgggtcatcagccggcgcaaaaccgataaaggagacgatatggttgttttcgagatatttgccgtctttgaccttttgtgcggtacctgtttttccgccgacgcgatatccttccacgaaggcattccgccccgttccctgagcgacgacgctttctaaagcatatctgatctgctttgacgtttcctgggaaataacttgccttttcgcaatcggcgattgtttcttaactgtttttttcgtaacgggatcaacccactctttggcgataaacggagtataaagcgttccgccgtttattgctgcggaaacggctgccacctgctgaatcggcgtgacggaaaccccttgtccgaaagcggttgtcgcctgttcgaccgggccgactctgtcaagcgggaataaaatccccgttccttccccttgcagatcaatgcctgttttctttccaaagccgaagtccttaatatattgaaacagcttttgttttccgagccgttcccccagctgtacaaacccggggttgcaggaattttgaacgacttcaagataagattgcgaaccgtgaccgccctttttccagcatcggaggcgggcgccgtcaacctcggcaaatcctttgtcataaaagtggtctctttgcaagtttactttttgctcttggagagccgccgcaagcgtaataatcttaaaggtcgaacccggttcatatgtgctccataccggcaggttccggttgtaaacggacggatctacggattgatagtcagccggatcaaaatcaggacggcttgacataccgagcacttccccgtttttcggattcattgcgaccgcaatcattccgtccggattatatttcgccgctgcattatcgagctctctttctataatcgtctgaaccttggcgtcaatcgtcaatttcatatcaagtccgtctttcggaggggtgtaatcatccgcttcatcaggcattttcttccccttggcatccgtataaaatttcactgatccctttacaccttttaagtcatcatcataataagcctccaatccgagaaggccctggttatcaatacccgcaaaaccgagaacatgggacaaaaagcttccgtacggataatggcggatgctgtcttcagccacataaaccccttttaagtcgagcgctttgatttctttcgcttttttattggaaattttccgcccctcgggtgagattttttctatggaggttttcttagtaatgtgtttgtagaccttctcttccgacatatttaaaactgacgcgagaagcttgcccgtttttatgggattttgaatctggcgcggtacgacaaagacggtcggcgcgcttttattcgtagccagcttcacgccgtttcggtcaaggatttctccccgctcaggctcaaacggcaaattccggctccaggaatccttagccagtgaagtcagcttttctcccatcacaaattggacatagcctaatctgctgtcaatgatcaaaaaaatgattacgccaaaaagcaaaaccagtaataaacgttttcgaaccgttacatttgaaacgcgcaagggaccgtccactccttatttaggcttgtttcaatttatgcctcagcttggacacatagaacggcggcgcataaaaaagaagcccgcgggcatccgcggacttctctgtcccgttaatcaggatttttaaatttcaccttgatcacggtattttctttcagttctttgccttttttcacactttggcttgaagcgtaaccttcaccgctcacatcgatgtgaatgcctgatactttgctgaattgaagcacttcccgtctcgaccatccggacatatccggcatcgtcatctttccgtctgtttttaagaagattttctgattggtgatcacatcttctccggctgtcggatactgctcttttacggcaacatcgctgccgatgacaatcggtgtgagatgttcatttttcgcttccttctcagcgcccgtgactgtcttatctgtcaggtcaggcatcttttggcttttcgtttcttcctgaccggaatctgttttttccgtcggttcgatattcatgtagtggaggctgtttttcatcgtcgggttaaagatttccgcgacaggatcagagctgctttgacccgcttttaactgcggctgctgcacggctacatagatgacgagcttaggatcatttttcggcgccatgcccatgaatgaaaacacatagttgctcgttccccttaaatatccgcctgtcccggcgatttgtgcggttcccgttttacccgcgacgtcaaaaccttcaattttataaggttttcccgttccgatgtctgacgtcacgacttctccgagcaggttccggacttttttcgccgtatcggctgaaatcggcgtgccaacttgctccggttttgtctgcttgacgacttttttcgtatcggggtcgacaatatgatcaatgacgtaaggtttcatcattttgccgttattggcaatcgccgtgacggcctgaagctgctggatcggtgttatcgccgatgcttggccgtaagccgtagacgctttgtcaaaatcatatttgtagttaattttacttgatacttcaccgggcagatcaatccctgttttttgatagagcccgaatttgtgcaggtactcattaaaccggtcaaaccccagtttttcgttggccagtttggcgaaagcaacattcgatgacctcatgaggccgtcatggaagcttgtcataccccatccggcgccatcgttccaatctttaacaggtttgcctcccactttatatgttcctgatttatatttctcgtttgcggaaaacacattttcctgaatcgccgcggcaagcgtaaagatcttcatcgttgaacccggttcatacgcgtacgacactaagtcgttgtaataattggtgacgtttctgatattcgggtcaaaactcggacgctgccccatcgcaagcactttgcctgttttcggttctacgacagccgccataatttttttcggtttatatttttccgctactttcgtcatgctgtcttctagaaaggtttgaattttctgatcaatggttaaatatacattgtcaccgtttttaggtgcggtgattttttctttgctgttcggaagtttccagccggatttatcactttcgtaagtgacggacccgtcacgttccgtcagatagttattcagtattttttcaagtcctaaagagccttgtatctcgtttgttttttcattcacatcggcatagccgagaacatttgacaaaaatatgccgttcggatagtagcgcttcgtatctcttaagaaagaaatacccggaagatccattttttcgatcttttgttttttcgcataagagatatcgcggccggctgaaccgaattccacctgcttcgcgccattcctgtttaagatgtccagaatctcgcttttatcaagattgataacggtcgccagtttttccgccgttttctctttgtctttgacatgctgaggatgcttcggatcactcgtcatttttttatcaagcacggcaatgagcttatatgtcgccgtgtcctctgcaagcactttgccgttccggtcaagaatagagccgcggctcgcttctatcgtccgctttttttcgtgctgctcggtcgcttttgttgcaagttctactccgtttgctttaccggttaattgaatgtacgccattctcccgagaatgacaaagaaaaagagagcgaaacaaatactgagtatcgctgctcctctgttcataaacttattttttttcggcatgggttatcattcctgtatgtttttcacttttttatctttcagattcaaaccgtgctttttagcgatatccatcaggcgctgcggctggcttaagtcagcagccgtcttttcgagatcaccgatctgcttattcttctcagatactttctcctccagtttttgcacctcaatattggattggtacgccgcgtatgcctttgatacgataaacattgatgtggagagaacggcaatggcaaacaggacgagcagcaccttttccccgagtgtaatggaagccctctttttgacaatcacctttttttcgggacttatcactggccgttgttgtttttcctgctggtaagctaagttgctcataggctgatgacctcctttaatgttgtcatttgctgcccgttattttcgtttctccgcaatgcggagcttcgctgaccgggcgcggttattttcttcaagctcctcttttgatgccgtaatgggctttctcgtaatcagttttaattccggttcaaattcttccggtatcacgggaagacccggaggcagttcgggaagtgatgatttttccttgaatgtcgtcttgcacattctgtcttccagcgagtgaaaagtgatcacagacacccttccgcccggcttcagcacctctatcgcttgcaagagggcctcttcaaatacctgaagctcgtcgtttacggcaattcgaatggcttggaatacacgtttggccggatgacctccgcttcttctcgccggagccggtatcgcgtcctttattagatcgaccagttggccggttgtttgaataggcgatttttctcttgcctcttcaattttccgggcgatctgcttgctgaatttttcttctccgtatttaaagaaaatcctcacaaggtcctcataccgccattcatttacgacttctttcgccgtaagggcggccgactggtccatcctcatgtccagcggtgcgtcatgatgataactgaatccccgttccggtgtatcaagctgcggagaggatactcctaaatcaaataaaattccgtcgacactcgtaatgccgtgttcatgtaaacactcttttaaataacgaaagttgctttttaccagaatgagctgtcctttgtattcggacaatgttttctgtgcgttttcaagcgccgtgtcatcttggtcaaaggcgatcaggcgtcctttttccgataattgctgcaataaatatgtactgtgcccggcgccgccaagggtgcagtccacataggttccgtccggtttgatatttaaaccgtcgacggtttcacgaagaagtactgtcttatgctgaaacatttgtgtcggtcccacctttatcaggaatgaattgaattgtcagttgttgttgtgatgcacgaagatccattatatatcaaatccaatcatgttttcagcaatttcagcgaatgaatcttcttgctcttctgtgtattgttcccatattaccttactccacaattcaattcgattggaaaccccgatgacaacacattctttttccagttttgcgtaattcagaagagatgacgcaatattaacccttccctgcttgtccagttcgcattcggtcgcaccggaaaaaaagaatcgggtaaatgcgcgggcgtcttttttggtgagcggcagagccttcagcttttcttcaatcagcttccattcattcatcggatagccgaaaaggcattggtcaagtcctcttgtcagcacaaactgctcaccgaggccttctctgaattttgcgggtacgatcatgcggccctttgcatcaattgtatgctggtattcacccataaacatgataaggacccccactttctcccctaaactcaccactatccgccacttctctccacaacctcattttacactgtttacacataaaaaaaaaccctgaactattcagggttctttaaaactttatttcaaagtttgacaatctgatgttggttttgaaaagaaaatggcagatgtttgaaggttgtgaagaattttggaccataacggttcaaataatacattacattccaaatccgttcctgcggagcgccgagcggtctgatgctgttttggattctttcatagtcacgcagcacaaaaccttctttttcttcaattcttttcgttaccgtccgttctaaaaacaagagctgatcctgaatgaaggcggcattcttctgtaagagcggctcaaggcttgaatcgaccttcagcgcttcgttccttgcgcttttatggacagcttcaatctgcgacttcgcctgttccattacagaagaaaactcttccggaatctgctcttcaaaataagcgtctttcaggtgtccggtgccgtgttcgatcgcttcctgaagcggaatattccgttctgaaagcttcttttcaatatggcgctcaagaatcgtaatgttcagtctcggcactaccggcgtcatgcggaagcccattaatgagaaagcctgcttcagctcaccccaataattgatctcccccggtcccgcgataaacgccagagtcgggatgagaaactcctgcataagcggccttgtcacaacgttattgctgaaacattccggtttttcttccatatgggtatgaagctcgtcgttcgtccacttcaggtcaagctccttaatgacaaaaacgccgttttctttttcaattaagaaacgctctccctcgtgttcgtaaaacagattagcctgatctttgtccgattcaataatcgggtgataaccggcttcccgcataagacgctgctggtctgacacggctttgacaagctcgtgattgtgttttaaaatctgctgaaacatacccgtttccagctttttaatccccggatctcccgaattcatcagaataaggccttcttcttgaaacaagtcggcgatcaacagctcaaaaaagtccgtgaatgtctctgatgagcgtaaacatcgcttcacgttttgaaggagtgtgtttgtgtgatccgtttcctcaaaagcagcgaacacttcatcaatccaagccgcgcatttttcctgatcaagctcggttttagccgccgatgtttttttccagtacgactgcggcagtttccgcttcaccggacctttattctctgttgacgtatgcacataattaatttcttccagatcgtgatcttcacccgccacccagaaaatcggagcgacaggaatctgcagcgcctcttcctgctgtctggcaagtacgataatggagataattttatgtatggtgtaaagaggccccgttaaaagaccggcctgctggccgcctacaaccgctgcgctttttggatctctcagtttttcgatggaggcctgcatggcggcggagtgaaatttttcgtgataggaggataaataatccgctaattcctctctggcaaacggccgcgaagagaggtcatgaagccgcttttgccatacgtcctctgaatgaatatcataatcaaaaaatgaagacatgttttctccatctatatagtgctgcacaaacttattttgacttttgatggaaagttcagttagctgcatctgtctggaacttcctttctccaataaatagttaggtttccgaaatgagtatagcatgttaccggaaaacctcaaaagactttgtttcaatttctttctaacgcttttatgctgcggtgtaaaaacgtgagatgaacggccggcaatccgcggctttccgcttcttttacaaggtagccgataatcgcatcggcctcggtccgcctgcctgccatgatatcgacgagcatggaagaatgatttttttccgtcagtctgcaaacttcgcaaaccttgttccacgctttttctctatcggcgaggccaagtattgtctccgcttcttcaaacacgtttctcatatattttttgtaagcgtcatttcttaacagctctccgtttttcacgcgcagcaatgcagttaacgggttgatgcatacattgatgatcagttttcccgttaaaagccgataccagtcgttttcatcatatacgggaaaatcccggtgcatgccggaaaagatgcttttgagcgtttccggccgggatgcgctgaatacactccatcttacggctcccgctcccgtatgttcaacggcatgatccgatatcttttttgctccgtgctcaactgtgccggcataaagcgaatgatccgtatgccaatctctaatgtcgtgtatgtgtcccatgccgttttgcaaaaacagcacattcgtcccttttaccgtctcaagatcccgcagcacagcactgagctggtgctgtttaacggctgcgattaagaggtcgaatccggaagtgatgcctgtttgcgctctgcatgccgccgtacattctattccgtctttcaaaagccgtataccgcctgagttaatcgcatcagcctgctccgtccgccgcgtaatgactgttacctgatggcgggacgataagtagtaagcacataaaaggcctaccgctccgccgccgataattccgattttcacactgtcacaccctatatctgcatttttccatattatcatagcagaagccgccgcaaattacttcaatttcgttttgagcaaaaagacaggcaagcatattatagttggaattttcaattaaagcgtttacaataatggtagaacacaacaaaggggagtttgtgttgaaaatagagcgcctgctcatcaactttaagacactcgaagaatttaaaaggtttaaggaatacgggatgcaggagctgtcgatgcttgaagatcttcaggataatatcattgaaaatgacagcacctcgcctttttacgggatttacttcggggataaactagtggcgagaatgagtttatatcaggtaaacggaggcgcgaatccgtattttgatcagcgtcaggactttttggaactttggaagcttgaggttcttccgggctatcaaaacaacggatacggaaaagcgcttgttgattttgcaaaatccttcagaatgccgatcaggacaaattcacgcatgaaatcagcagaattctgggataagatgaattttgagcccgttaaatatgatatggcgcgtgataaaggagaaaatccttacatctggcatcccgatatggacggtgaaatgacatccggagaaacggcataataaaaaaccggccgggccgccgccctcaggccggttcattttacaggctctgcgccgatttcctgtcgtcttcttttgaattgaccatccttctcgctctgtccataatgtcaattaacgctttataatcttcttccgtcatctccagcttgtttctcaagctttcattttcctcacgcagatcctcgacttctttttgcagcgcggtcagctgttctgtgagtttttctttttcatgacgcacatccgctgcggccggcgactctttaaattgctgaagaaacaaaatgacatcatcaatggacagctctttttctccttccgccctgcggatcggaggctgtttgacggttcccggcagattggcggaatgcaccccgatctgctttcttaattccttccgctgttttttcgccagttctatccctgactgatattgttttctgacataagaattccatctgaacccgcaggcggcagccgttctcgtcagcgctctgccgacttcttcaaaagcggaaagctgggtcccgccttcccgaatatgcctgagcaccacttcggccagcagcaaatcttcatcttgcgtccacgcgtcttgtctcgttatcgtcaatcgtatctccctccatatttgctcatttacctcatacatatgccgctgatagattagatagactactggcgctcacaattttttcggcggaagcaggccggaggggcaaaaaaaaagaaaagcgcaggaaccgagattcccgcgcttttcttcatacattaattgcttttaacatttatgtctttgccgttgtatgatccgcatgctttacatacacggtgagacaatttcatctctccgcatgacgggcattctgtcataccaggtacatttagtttgaaatgtgtacggcgcaatctttttttcattttagaagttcttctaaaaggtacagccattattcccacctccttaaagagttaagattcatcatcttgtgttaagagctttttcagatccgcaagtctggggtcgatttgatttttcttgtcttcctcagaaatcacttgccaatccttccccacttggggagcggctccttctttttgttcagtttcacaaaagacttgcataggaatttctaaaagaatctcttcttttacgatcggagttaagtcgacgatatcgtcttcagcaatatgaacgtcctcatcttctatatcatccgacttatgaaatctaaacagttcttttgtcgcgattgtaaatggatacggcacatcaactaaagttcttgagcacggcaaaaccatttcgcctgaaatcgtaaagtcaaacgaaacttgcttggattcaatctccgcgcggcccttcacccggacgggagaaatgcggcggatgtcagaattcaattttgtcagctcatttaactcaactgtttcatcaaattcaaagctctttttcgccatttgatgaagctgataaatcgtccatttcatttgtatcacctcaggaaagcaacaaacatgattatagcttttcagaatgtttttgtcaatattttttctttacagcataatgccgccgtcatgcaatcgttgacagccggataggctatgcatacactaaacgaaacggactaaaatatgcacttcatttgcaaatgtaccacacgaagcaaaacatagcaagaaaggcgggacaaatatgaaagcagtcggcctggttgttgaatataatccctttcataacggacaccgctatcatgcggaacaagcaaaaatcaaaacggacagcagcgtcgcggcggcggtgatgagcggcccttttttgcagcgcggagaaccggccgccgtctcaaagtgggcccggacaaaaatggcgctggaaaacggcgtggatatcgtcattgagctcccttatatgtatgccgtacaaaaagcggaattattcgcgcgcggcagcgtttcgcttcttcatcatttaggatgcagcagcttgtttttcggcagcgaaaacgggcggatcgaaccctttattgaagcgtctgaagcgttcagccgaaaggaagatgactgcagcctgattctgaaagaggagctgaaaaagggtctcagctatccggccgccgcctcaaaagctttttcacacatattcaaagggcgggacatgctcgatttgtccaagccgaacaatattctcggttttcactacgttagagcgatacacgccttcggttccgctatgaagccttatacgacagccagaatcgcttcccagtatcatgacgccgagcttcccggagataacagccggatagccagcgcaacaagcatccggaaagcgctgatagaaaaaggaacggcggccgcaaggagctttctcccggaagcgtctgcgcgtgagctggaggcatacagaaattcatacgggatatggcacagcaccgaagactatttttcatatgtaaaatacagcctcagcactctgtccgctgaagaattgagccgaatctatgaagtggaagaaggccttgagcacagaattctgcgcaccatcagacaagcccgatcctatcgcgaaatgatggaacgattgaaaacaaaacgatacacgtggacgaggctgcagcggatgaacacgcacattctgacacggacgaaaaaggaggacatgcatcggctcttacagccttcaagcgctccttatatccgtcttctcggaatgacgaaaaaaggacaggcgtacctgtcggcaaagaaaaaagagcttaccgcacctctcgtcagcaagctctcttctttctctcatcccgctctggatctggacatactggcgggacgggtttacagcctgccgataaaagaacctgaacgcacattttttgagaaacaggaattttcacaagcgccgatccgctatgatgaagacgaacagcgttttttgaatgcgtaaaaaaagcacctgcctgtatcaggtgctttttactttcagatgatccaaatagtcaagtgcgtcctgcatggtgtcgacagggacgatcttcatatcggacttgattgctttcgccgtttttaccgcatttttgtaatcagaattttcagctccgttttgattcggcgcaaagaaaatatcttttcccgctttgtctgcggcgacgactttctgatcgattccgccgatcggtccgaccttgccgtccacgtcgattgtccccgttccggctatattatagccttttgtttcgtcaggttttgtcagctggttgtaaatttctaaagacatcatgagacccgcagaaggcccgccgatattttcaatgctgaaatggagatccggctttactttcacgttccgatccgtatataacgcgacgccgattcccgctcttttcgggtcgtccgggaatgatttcagcgcaatgtcaacggtcttttctttcgtgtcccgttcaatgtgaaacgttactttctcccccgcttttttgctgctgatataatcaatcagcttttcagcggattcgtatgttttcccgtccgcgctgatgattttatcaccgacctctatttttccttttgccggcatgtcagagacgactgagctggcgaaaatcccgttaaatgagtatttcacctgtttcccggctttttgataagcggcaatgaccgcgttttcttgggagcttttcatcatttgcagctggcgcttcatataatccgagtccgattcgccctcttcttttatgctttcatcagggacgatttcatcgtaaggatgcactttcgcccaaagatatgtatacggattggcggggcctactttgacagtcatcaaggaaaggcttcctttttcaggatagcctccgtccaccttaatcagcggtctcagctctgatgcttctcccggctgtgtaatgtaatacggaagcttaataaatgtaacagcaattaataagatcaggatgataaacacccagcgaaaatgttttgctttcatatgagttagccctcccagttctctatttcttgtttaatccggccgatcatccggtctgcggcttcttcgcccgctgtgatcatatgatcaatgttggcaaaagaacttgagctgaatgattcaagagaagggcggatcatgacgtctgcggcaatggtctggtgacggaccaattcattttgcagtatatccatactttgcatgattacatcaaaaatatgtgccgctttttccgtttttttcacccgggatacgtcagaggcgatgacgatatcagcacccatgtcttttacggcggacaccggtattctgtcgaccaccgcgccgtcgactaacatacgtccgttcattttttgcgggacgaaaacgcccggtatgctgatgctcgcgcggacggcttcggatactgaacctttcgtaaaaacgagtttttcgccggtctgaaggtcgcaggccacgatgccgagcgggatccgcagttcttctatcggcttgccgtacgtataggcatgaacgagctgcctgatgcggtctccttttaaaaatccgagcctcggcatcgtataatccgcatacagccgccgcttaaatgctttggcgacttttttcatcgtagccacgtcatgcccggccgcataaaagctcccgactaatgctcccatgctgctgccggcaatcatatcaattggaatctgatgcttatgtaaactggataacactccgagatgagcgatgcctcttgcccctcccgaacctaacgctaacccgattgtaggtttggccaacgcgacgaaccccctaatagacatcctatacatgaattctatggtctaaattgaacccctatgctcgtatattagtacaggatgacaaataggtacttgcccggccgcctttaaggtctgttctatattttatcatgatataaatgtcagtgtgcaattttagcatcggggaggtaagaatgaatttgtctaagtttcatacatttttgatttcattgtttttcatttttttgacggcgacggttatttcacaccctcaggcctcattcgaagcctccaaaaccggtctttccatgtggtgggaggtcgtttttccttcattgcttccgttttttattctatctgagcttttaatcggattcggcattgtcaaatttgtcggccttttactcgaaccctttatgcgtcccattttcagagtgccgggggtcggcggatttgtactggctatgggcatggcttcaggcaatccggccggcgcgaagctgactgcacggctgcgccaggataaacaaatctccagagtagaggctgaacgcctcgtctcttttaccaattcatccaatccgttatttatattcgctgccgtggcggtcggcttttttcataacgcgtctctcggcattctgctggcatcggctcactatcttggaaacatcgccgtcggcctgacgatgcgttcatacggacggaaagaagaagcggcgtataccggtaaaaagacgatcgctctcccttctctgaaggaagcatttctggccctccacaaggcgcggctttcggaaaagcggccgctcggaaaaattttgggcgacgccgtcacctcttctgtacaaaccttgctgatggtgggcggttttattatattgttttcggttttcagccggttattatcaatcgtacaagtcatggatgtgctttctgtatttacaaacgcgctgctttccctttttcatcttccggcaaatctggacatccctcttatcagcggaatgtttgaaattacacttgggagcaagctggtcagtgaagctgatgccgccttgctgccgaaagccatgattgtgagttttattctcgggttcagcggcctttccgtacaggcccaggtagccggcattttatcggaaacagatatccgctttaaaccgtttttcgcggcgcgtatccttcagggcatttatgccgcactctttattctcttactgtggaagccgctttaccttgcattggacgaaccttaccagtccgtattcctccctttccgcgatcaggacgcgggatctgctgccgtcagcggatggaatacacttgttgaaaccgggcccgccatcacgctgacagctctcgccgtatacgcattgatttattgttacaggctgtcagcacggacaaaaaaaggatgagacgccgatcagcgcttctcatcctttaaatttctgcttcagcgcctgttcaacttccggaggaacaaactctgaaacaggcccgttatattttgcgacttcttttacgatgcttgaacttaaaaaagagtactgattgttcgtcatcataaaaaaagtttctattgattcgtcaagcacgcggttgacggaagtcccctgcatctcatattcgaagtcagaaacagctctgagccccctgataatcgccttcgcccgcttttttttcgcatagtcgattaacagtccctgtgacgtctcgaccgtaatattcggaatgtcttttgtcacttctcttaacagctcacagcgttcctcgactgtaaacagcggctgcttagaagaattattgagcacgcatacgtacacctgctcaaacacgtttgccccccgtctgataatgtccaggtgtccgtaggtgacgggatcaaaacttccgggacatacagctatacttgccacatcattaccccctatttcggtatatcgtcactcctgtaagcccgtaaatttcccttcttgttacagaaagcgcgccgacggcttcaggaagcacaacggctttatcatgctcggctacgacaaaaccgtcttcattcagcatgttctgctcatcaatcatttcgataagcgctttcagcttttgttccttatacggaggatctaagaaaattccgtcaaaacctttttcccgtttcgccgcggcatagagggcccgctctgcatcattgcggtatacttccgatgaagacagcagatcgagcgctttgatattcgcttttaccgtttggatggctttgaaatcacgatccacaaagatacagcggtcaaatccgcgcgacagcgcttcaatcccgaggccgccgctccccgcaaacaaatccagccctgttcctccgtcaaaatacgggccgatcatattaaaaatagactcttttactttatccgtcgtcggccttgttgatgtgcccggcaccgcctttaaggctcgtccttttcttgaaccggaaattactctcattattcacaccactttttctgaaaactttgatgtttctcatcggctgagccgttatgtataaaaacaatccctatcttatcataaagcattctttcaaacaatgaacgtgaaaaacgtgtatacatattcacattcctgtcaagactacgtgtaacagcatcaatgaatgatgttgttgccaaccgcggagaagacttacgtttccccataagttcttcctccggtttctcctctcccttttccttctccttaacttgttaaggaatagaaggaccccgcaggtatctgcggggatttttttatataccgactttataatcgtactctttcgctttatcaagctttgattcaaattccagctttaaaaaaggtttataagaaggctctaccttcttcacataagaataagaagaaatcttttccattgttttttcgatcaggtccatatcgcaatacagcacaacgtatttcagccgcttggaaacataatgaacgttgccgaattttctcagcattttgctgtgttttaaagaatgcagatatacgattatgccttggcgcttattttccatcatgatcacccgcctgactttctgttcattttatgtaaaagacgagacggccgtctcgtcaggaaactttgcatccgcagccgccgccggaaccgcagccgccgccgcaggatgacaggccgtcaaaataaggattccccgtcggcacttttacatgctccgagacggccgttccgagttcaatgctgatctcgtcaagcagcgactgaagctcagtctccgcttttttaaattcggccaccttatcgtttaaatcgagctcccgcttcatttctctcattttgcgggaaatctctctataatcaggatggtatttgccaaagcgctgcacatcctcatactgctctttaacgctcataaaagaacgaatgatccgccctgcctcttcatcttcacggagacgcttgtaacaatcgcggtaattttcagccgtctcagactgcagaatcatgccggcaagctgttccgcttcactttgaagcttgacggactcaattgttgcatacataaatacgcacctccagttgctagtttaccatgaaaccacccaattggaaaatgcggcgtttaaacgctttttaatcctgcgaacgcatggcgtgtaccatctgcatcatcatctgcgccatttgaatcccgtttgagaattgacttacccgatgcggtatcgtcttttcataaaaattcatcatgtcaagctgaaaggaattgagatcgtccggttttctcgcaagtctgcggtaccagacgggacgctgccgtataaaccgtttccgttcctcatctgcggatatgaattcctgaacctcttttcgcatacacgatccccttctttaatcctttctgaatgaaaaaggatgttgtccggagccttgccggggctgcttcgtgctgctccccgaaaattggcttaaaaggctttgcaatgatgaaatggactggctcattttattgatctgctcattcatttggttgatatccatctttttgacggcagtgaccatttttgaaacgaaatcgttcttttcagctggttcctgtttggtttccgcgtcggaagaaggctgaacggcctcgtctttaaaagggtcccacatcgaatcatcctcgcccaggagaacccagttttcatagacttcctgccagcttctttgttccttgcgaacattttggatcagtttgggatgcttttttacgaattgtttaaaatcatcgattgattgccgtgattgctgattcgccacaattctcaccccctccgaaaagttttgcctgctataatgtatcggttcatgcgccttaatgttcgcctaaattgcgaaaaaaagcaggtatatttttttcagcaggagcgccgctcgcgaaaaatcataaaaaaaccgcgggggacgcgcccctctgcggttttttactgccaaggcttaatgaagttttgcgtataatacttccggtccacgccgacaccgaggtgcgtataatccgggcttaacagcgccttcctgtggccttcgctgttcagccagccctccacggctgcaggaccgtccacatagttgtaggcaatattttcaccggcctcccggtatttcacatcgcctttttccaagcggtccttcagagtcccgtatttctttgagacgtgagagaaatacttgttatccttcatgtccttgctgtggccgaatgccactttcgcggcgccttcgtcccatttcagccttgccagtccgtgtttcacgcggatgacatttgtaatgtcgagaatctgctgttcactcgctcgttcaatgtcgttccattttttatcagaaactggctcgggttctgtcagctttcctctgtacatgacctcatacggcctttgtttcaccagcgtttccgcatcaaaagccctgatgcttgacagattcccgtcaaatttgtccatgtacagctgaacatacattccgcctatcttgacggtgggacgggtattgatatcttcttcggaaaactcaaaccgatacgtgtttcccttgtcagtcacattgacaaaaggagaaacctgcgtcgttttaaaaacttcgcccgtcgattcgccgatcttaaacggttttgcgttgatgccgcttcccgaagcgtataaagtcacggctttatcattcaaaataccgacttgtacgtattggtctttcccctggttgtacacccaccactcgtaatcgtaggcagaaggatctttccgggacggttccccaagtttctttttcacatcggcggcagatttccccatgagagaaagcagtccggatgacggcattttcagccgttttccgctctcttcttcattggaaacctgaggctcctcctgattggtctttttctgaggagccgatccatattgtataaacagaacatacgctccgtaaataagcaaaaggataacgagagcccttgcaatatttttcaacctctcacccccatatcatcaaaccgttctgtttttgtgtactcttatacagtacagcctatttgcatcgtccgtgatttatgtttaatggataaacccctccggacctccgtcttcagaaatgtcagacagcgcccggcctgcttgctcatttgattgctcggccaacgaaagatcgccgagcgtaacaatgccgaccagttttttatcccttgtgacgggaattcttctgagctgatgttcagccatcaaatggagcacctcctccacagaggcgtcttcttctgcactgataacccgctctgtcattgcgtcggttattttttgagagttcggcttttttgaagcaattccccgtaatacgagatctctgtctgtcacgatcccgacaagtgtggcgccgtcttcatccactatcggaatggcgccgacatccgcgtctttcatcttcaccgcagcttcatatacattatctaatactgtacaatattgcaagtctgacgtcatgagcttattgatctttgtcattgcggaattcctccttttttctgctactattgtcgtcaaatttttgtttttgcatactttcaccgtatgaatcattgaaagtgtaacgctttcatactatgattgtcaggaaagggcatttttaaaaggagggggaaggtttgaagtttgaaaacagcggtcttgaaggggtaacagcggagctcagccgcttgaacgatctgatggaaggcaaagggctcattctggctggacaatgggattatgaaagagtgacttacgacaaaaagttttcagtacctgaggggacattttatctgcggattcaaggaacggcaaaagagggcgatgtcggcggcagacgggccgtgattcagctgaaggcccctcttttaggaaagcattattatccgcacggcgtagaatacggcagcgctgaagaatttccggaacatgtcatcgctgaaagcaaagctttactgcttgaattggaagagtcattaaaaacagtgcaaatgtaataaaaaagtacagcatattctgctgtacttttttttatgagacggtatgctcgatatacggcggctctgacagcgtatctttttcccgttccgttctgacccactgaaaaaagatgacagccaaatatattccgtagaccgcctcttgaatgattttcatcagcactgccccaagctgctgatcttccagaggaggtagcgtgttaaacatctccggcccggataaagggatctcctccagcaaatctaaaggaacgcaaagcttcattgcttcggcccaagccgccggatctgtatacgtggcatacatgggcgccccgctgaacataatgagcgcgcaggccggcgttaacaaaatcccgtccgccataatataccccagcttcattaaaccgctgagacggggcagaccgtccaccttatgcacaagcggccaccacataaaaaacgccgttacaaagatgagtccgttcatcagcgtgtgatacagcgaatccgttttgacgaaatcaaatataaacgggatgtgatacagcgaaaaaataccgttaaacagcactaaagcgataagcggcattgaaaaaaatgaaaacagcggctttacgacaggacggaagatcagttttttccatgcccagccgggaattccggagatcaacagcggcggtacgactaaaaacagaaccgccatctgcgccatatgggcgctgaacatcacatggcccaataaatcgaccggacttcccgcagccgcgtaaaaaaatagcgcggaaagcacaaacagcaccttctccttaacggccacacgtcctttatgccggctgcaccagtaaaagtaaacacctgttatcacggcagttatacaaaacagatacgggctccacattgcgcgaaacccgaacatttccaaattaatcaaatctctcactccccgccgccccgattaccaccaaataatcgtgacaaatgcaagcacggtgataaacgcgacaaatattcccgaatacagaaataatgacggcgcttcatgccccttctggctcatatgcataaagtaaaacagctgaaagatgacctgaatgaccgcaagcaggatcagaaacggcatcgtaaaccatccggcaatgccgtctgcagccaccgtcaaaaacgcgacaagcgtaaggccgatcatcaagccgaaggagatgacctgatatttcatctcctcggcatttttccttctccgatattcaagatccgtactgacagtctctctgtttttgttatcgtccatcgttatcccaccatccccatcaaatatacaacggtaaagataaagacccacacgacatcgataaaatgccaatataagctggccacataatatttcggcgcattataaaggctgagccctcttttcgcattccggatcatgagcgcgctgatccacaacagcccgaacgccacgtgtgctccgtgtgtgccgacgagcgtgtaaaacgctgagccgagcgcagagcttgtaatggtaaatccgaactcgtgagtgtaatgcataaattcatagatttcaacccctaaaaatcccgctcccaataatacggtaaccagaagccacacctgcatttttttaaaggagaaatttttcatatgatacatcgcatacacactcgttaagctgctcgtcaaaagaagcatcgtcgcgataaacacgatcggcagctcaaacatctcagccgttgacggccctccggctttagattcccgtaaagcaaggaatgtcgcaaatagcgaggcgaacagaaccgtttcgccgccgagaaacagccaaaatcccaaaaacttatttttcccctccagcgttgctttttcaggagaagccggaaaggtttcagccgtcattttttcctgcagctgcattacgccttcacccctttatcatcattcggcagatcttctttgtgaatatgatagccgtaatcatcgaccacagagcgaagcagcatggtaaagaatgtgatgccgagccctatgaagataaccggaagcccccatgaataatcggagtggtataaaaacccgaacgctgccacaaacagcccgaaagatatgataaacggcatgatggagccgttcggcatatgaatgtcctctacaggctctgcaggcgccatcccttcatttccggcctgcttttcaatccacagcgggtcaagtccccggacaaacggaagctgtttaaaattatattccggcggcggcgaagagaccgcccattcaagcgtacgaccgtccagccacgggtcgttcccgacgtatttcccctttattgaggtataaataatattgacgacgagtaaagcggccgcgcctgccatgaaaaacgcgccgattgaactgatcaggttgccggtatcaagcccctggccgggcagatatgtgtaaacgcggcgcggcattcccatcaagccgagaaaatgctgaatgaagaaggtaagatgaaacccgataaaaaataagacgaacgaaattttccccatcgtttcatgaagcaccttcccgaacattttcggccaccagaaatgcacgcccgccaggatgccgaacacaacgccgccgataatgacgtagtggaaatgcgctacgacaaaatacgtatcgtggaactgataatctgccgctgcggccgccagcatgacacccgtgactcctccgagtacgaaagaaggaataaaggcgacggcatacagcataggcgtcgtgaatttgacgtttcctccccagatggtcaaaagccagttgaaaattttaatgccggtaggcaccgcgatcgccatcgtcgcaaccgcaaatatcgcattagcgatcggtccgagtcccgttgtaaacatgtggtgaacccataccatgaacccgagaaagccgatcagcacgatcgcaaagaccatagacgaataaccgaacagacgtttcctcgcaaatacgggaatgatttctgaaaaaatcccaaaggcgggaagaattaaaatgtatacttccggatgcccgaaaatccaaaacagatgctcccagattatcgtattgccgcccaattcaggattaaagaaattcgttccgaacaaacgatccagcatcatcagcgccaaaccgacggtgagcggaggaaatgcgaataaaatgagtgccgacgccacaaatgtcgtccacgtaaacagcggcagtctcatatacgttaaacccggcgccctcatattaataatcgtggcgagaaaattgatccccgcaatgagcgtacctaagcctgatatttgcaggccgagcacgaaaaagtctatgccgtgccctttcgaattcagcgcaagcgacgcgtacgacgtccagcctgcatcaggagcgccccctaaaaaccagctcagattcaaaaagatgcctccgaagaaaaacagccaaaatccgagcgcattcaaaaatgggaatgatacgtcacgcgccccgatctgcagcggcacaaccgcgttcatcagcccgaataacagcggcattgccgccaggaagatcattgtcgtgccgtgcatcgtcataatttcattaaactgctgagcacccataaaatcgttccccggcctcaagagctgaatcctgataagcatggcctcaagtccgccgacgacgaagaaaaatcccccggcgatcatatataaaatcgcgattttcttatggtcaaccgtcgtcaaataatcccaaagcaaagagctttttctttgctgtcctgtaagcgtattcatcatttgcgacctcccccctgatatctccctgtcctcacttgttctccgctttcagcccttttaaatattcatacagcgcatccgtttcagcgtccgagagcttcggataagtgcctgtcattttattgcccggtttaatgctgtccggatttttcagccaggcttttatattctctttattcgcatccttaatgccggccactttgacccgttcaccgaaggtagcgaggttcggagccgttcttgccgcttcagcccgtttatcattgggctcaaccgcatgacagctcaggcagtttttttccttaaacagctcttctccttgtgctgctaaatcggaatctgttgtatgcttataatttttcatcgctttcgtccattgtttaaattcttttgacggcagcggtttcactttgaaatccatcagcgcatgtgaaggtccgcacagctctgcgcatttcccgaagaaatattctcccgcttctttgctgcgtttagaatcgaaggtcagaaagaaagtgttgtcattatccgtattcgtatcgatttttcccccggctgacggaatccagaaagagtgtttcacatctgaggacttcagcttgaaatagacgcgttcatctgtgggaacgatcagctcctgacttgtcacaaacccgtaatcgggatactcgaattcccaccagtataaattcgcccttacattaatcacgagcgcatcctctgctttacggtttttcttatccatcggcgacgtatccgccagtgccaatgtatcgatgacaaccggaatgacaagaataatcagaagcaggatcggaataacggtccaggtgatttctaaaaaacggttcccctccacctgtttcggtatcgtgtcttcccctatacgcgaccgtctgaatctcacaatgacgtaaaagaaaataactgctacgaccgcaacgacgacaaccatgataagtgtgctgagcaccgtcagatcatattgtttatcagccacttcgccggcaggcttgagtgtggacagaaacggttttccacagccgctcaataaaagcggcactaaggctaataatgataaaagacgccaacgctttaacatttcacccaaccccttttttgaatcagtacgagatgcacaagcagtaaatctgcttccagccgaaatacttcatttcctcatttcttaaaatatgagattttttacttaaaattccatctatgtataaaagcaaagccgcctgattaaacaaaaggtcaaggcggcgtttactagttgtcattgtttgttttggcgatcaaacaagctcattattcaattaaaacagcgtgaagaccaccatcgctacaaaataaatggtcatgtagttaagcgaatagacaaacataagggttgcccacttcatgatgtttttcatgcggaatcccatcagtccgagaacaagccatccgacattcagcaaagtgccgagaatgacgatcggaagaccgagactgccgaggaaaaacggaagcggcagcaggcatgcgacccagacgataatctgtcttttcgtcacttcaaagccgtgcactaccggaagcatcggaatattcgctgctctgtaatcttccgtctttttaatcgcaagcgctaaaaagtgcggaatctgccagatgaataaaatcatgaataaaacccacgcgacaacaccgatgtgcccttcaaccgctgtccagccgattaacggcggcacggcgcctgatacacttccgacaaccgtattaatcgtataacggcgtttcgtccacattgtataaagaacaacgtacgtaaacacgccgataaaaccgatgactgctgccatcacggtggtcatcaaaagcatgataagtcctaaagcaatgagtaaaattcctgaccacagcgcttgattcggctgaatctttccggttaccgtcggtcttactttcgtgcgttccattaaatgatcaatatcacggtcgtaatagttgttaaccgcacaagaaccggcgatgatcaaagaagatcctattaatgtaagaagcacggtgtttaaattgcctaaaaaactcagaccggatatatgtaacgcaagccacatgccggtaaaagtcgtaattaaattcgaattgacgattcctattttgataagcgaaaggaaatccttccatgccgtcgtctcttcaatctgtccgtctatagctgtatcgtttaaaattctggaattagccataacgtaaacctcccttacaaacctaaagcaggttttttaagacctgcaactctatcatacaagataatgacctgtaaaaaaacatcctcttaaatattaaacgagaaacaggaatttatttgtgaactttttatgaattttaccaaatccgccggcttcataataaagcggttactttatttctatcagacccatctggaataatcaaccccattatctaagaagtcctgattctattatatttttgtgaacaaacagaattgagaattgccacaaaacacatattcgcttacacttggtacgtatatcattttgtccagtttgttaagaaggtgaatgtaaaatgaataaagctttgaaagcgctcggcgtgctgacgacgttcgttatgctcgtcgtgctgatcggcggcgctcttgtcacaaaaacaggatcgggtctcggatgcggaaggcagtggccgctttgccacggccggtttttcccggagcttaacgccgcttctatcattgaatggagccacagactcgcaagcggtgtctcaatcgttctcgtgctgagtctcgctttttgggcatggagaaaagtcacgcctgttttccgtgaaacaacctttctcgccattatgtccattatctttttatttttacaggcgcttctcggcgcattagcggttgttttcggatcaaatgcgctcgttatggcgcttcatttcggcatatcgctgatttctttcgcttctgttctgattttgacgctgctcatatttgaagctgataaatcagacaaaaagctcgtcaagccgctcagaatcggcaggaaaatgcagtttcatatgatcggcctttcgatttacacgtatatcgtcgtttatacgggggcttatgtgcgccatacaaaatcaagccttgcctgtcctgacgttccgctttgcagcagactgaaccacggacttccgtctcattttcaggagtgggtgcagatgggccacagaacggcagcgctgcttctgttcgtatggattcttgtcgcttttgcgcatgcggtgcgctcctacaaagaccaaaaacagattcttgggggctggatagcggctcttgcctttgttgtattacaggcgctctccggaatcatggttgtttattcagaaatggccaccggctttgcacttgcccattcgctctttattgccggtctgttcggtgtcttatgctatttcttattattaatcgcccgcttccgctatgaatcaaaacagcggaacatctgaggcacatgaaaaggccgaagcatcaaagcttcggccttttcacatataaaaaacctgatcgcacacggggcggatcaggttttttatgtttattttttacgctttttcaatttcgatcagtaaatcgcctgtctgaatcggttcaccgtttttcacatgaatctgctgtattgtcccggagaacggcgcctgtaccgtcgtctccattttcatcgcttcattaatcatcagatgatcgcctttattcacctttgccccggtttccgttaacaatttaataaccgttcccggcatggatgccgcaatgtggcttgggtttgtccgatctgcttttaatttttcctgtacggacgatttaatgctttcatctttaatgaccacttcgcgcggctggccgttcaattcgaaataaacgacacgtgtcgcatctggctgcggttcaccgatagatacaagcttcacgatcagcgtttttccgcgctcgatttccacttcgatttcttcaccgagtgtcatgccgtagaagaaagtcggtgtgtccaatacggaaatatcaccgaagcgttcagccgttttaacatattcagtaaatactttcggataaagagcatacgcgattgcgtcctgatcactcaattccatctgatgcgtttctttccattcttctttaatgccttcaaaagataccggttcaagcagctcacccggtcttaccgtgatcggcgtctgtcctttcagaacgagcttttgcagtttttccggaaatccgccgtgcggctgaccgatctgccctttaaagagctcaacgactgaatccggaaaatcaagcgtttcgcctttatcataaacatcttgttctgttaaattgttttgcaccatgtaaagcgccatatctccgacgactttggaagaaggtgttactttcacgacgtcgccgaacatgcggttgacaacgctgtacatgtctttcacctcattccagcgatcgcccaggccgactccttttgcctgctgctgcagattgctgtactgcccgcccggcatttcatgattataaatctcagtatgcggagacttcatcccgctttcaaattcactgtaatactgacggacggattcccaatattgtgacagtctttccacctgccggacatccatttcaggacggcggctgtttccttcaagcgcatgataaaatccgcttgcgctcggctgtgaagtcagacccgccattgagctgacggcgacatccacgatgtccacacccgcttcaacagctttggcatagagaaagacgccattgccgctcgtatcatgcgtatgaagatgaacgggaatatcaatcgtttccttcagcgctgagacaagttcgtatgcggcttgaggtttcaaaagaccggccatgtctttaatgccgagaatgtgcgcaccagacgcctcaagctctttcgccatagaaagataatattgcaaatcatatttcgtccgggtcttatcaagaatatctcccgtgtaacaaatcgcagcctccgccacttttccggtttcacggacggcatcgatggccagcgtcatcccttttacccagttcaggctgtcaaagatccggaatacgtcgataccggactccgctgactgccggacaaatttttgaatgacattgtcgggatagtttgtataaccgacggcatttgatgaacgaaggagcatctggaacaatgtgttcggcacttccttacggagatcttcaaggcgtttccaagggtcttcttttaagaaacggtacgctacatcaaatgtcgcgcctccccacatttcaaggctgaacagttcaggccacagggcagccgtaggattcgcgatttttttcaaatcgttggacctgatccgtgttgcgagcagggactgatgggcatccctgaacgttgtatcggtcaggagcacggatttttgctctttcacccagtctgcaagtccctcggcgcctctttcatcaagaatctgtttcgtaccgcttgccggcttttccccgatatctaacgtaacggtctgaggcttatcaaatgcaggtttttcttttttcccgattcccggaaaaccgttcaccgtgacattgccgatataggaaagcatttttgttccgcggtccttctgttttgggaaaacaaacagctcaggcgttgtgtcgataaacgatgtgtcgtattggcccgtcaggaatttttcatgctttgccacgttttcaagaaacggaatattggtcttaatgcccctgatcctgaattcctgcaggttgcggaccattttcgctgatgcctgttcaaacgtcagcgcccatgtcgacagcttgacgagcagtgaatcataataaggtgtgatgacggcgccctggaagctgtttcccgtatcaaggcggacgccgaaaccgccgcctgagcggtaagccataattttacccgtgtcaggcataaagtcattcagcggatcttcagtggtcacacgtgattgtatcgcatacccgtttgtaaaaatgtctttctgctctgggatattgacggcgcggctgtgcagtccgtggccctgcgcgacgagaatctgcgtctgaacgatatcaacccccgttatcatttccgtaatcgtatgctccacttgtacgcgcgggttcacttcaataaagtaaaattcaccgcccgctacgagaaattccacggtccccgcgttgatatagccgacatttttcgcaagcgccacagccgcttcacagatttcgtcccttaattcaggctgcaaagatacactcggcgccacttcaatgaccttttgatggcgtctctgaacggaacagtcccgctcatacagatggacgacattgccttctttatctccgatcacctgaacttcaatatgcttaggattttcgatcagtttttcaacatacacttcatcatttccgaatgcggctttcgcttctgatttggcccgctcaaacgattctttcaattcgctttcgcttcggacgattctcatgccgcggcctccgcctccgagcgatgctttaataataaacggaaatccgtggacttttgcgaattgttcgacatcttttaatgtttcagccggtccgtcactccccggaataacggggataccggctttttccgcctgctccctcgcctttaccttatctccgaacatatccaaatgcgctgacgtcggtccgatgaatacgatgtcctcttcttcacagcgtctcgcaaattggatattttcagagagaaatccgtagcccggatgaatggcatcaacgccgtttctttttgcgatctcaataatcccttcaatatcaagatacgcgtcaatcggttttttgccttcgcccacaagataagcttcatccgctttatagcgatgataggagcccgaatcttcttttgaataaacggctaccgttctgatgttcaattctgtgcacgcccggaaaatccggatcgcaatttctcccctgtttgctactaacactttttggatggattgttgtgacaaacttttctcccccttggcctaataaatatgtagtttataataaaggaatatccgccctgtgtatacacttgttttttagagatacacagatttttccgtctgccgtctttttacccctttagacggaacgggctccctctttttcttcttttctgagtacttgacatgcatgctgacattcaccaatataccggcgctcgtcaataacaaaaacattgatgatcccccgtagctgataaacggcagcggaacacctgtgatcggaattaaaccgctgacaccgccgagattgataaaggtctgaatcgcaatcatgctggatatcccgattgccaaaaggcttccgaacggatcttcacattttctcgcaatataaaaaccttttaacaccacaaaagccagcagcacaatgacaaacaggacgccgaaaatgccgagctcctctgaaataaccgccataataaagtctgtatgcgattcaggcagataaccgtatttttgaatgctttctccaagaccgagaccgaaaaaaccgcctgagccgatcgcataatacgaatttataatctgcagacctgatgtgctggcgtatttaaatggattttcaaggctttcaaaccggctcatacgcccgggtgtcaaaatatcgtcccatttcagataaatgatcgggctgacaaggagtaatacgattcccgccatgagaaccagcctgagcagggtccttccgctgaatcccgaacacataatgacgcaaaacgcgatcagaccgataatcatcgccgttccgaagtcgggctgaatagcgataagcgcacaaatgactacggtgacgatcaccggcggcgcaacccccgtcaaaagctgatcgatgtagctttgtttctttgcgtacaccgcggcaagatacagtatcagggtcagcttgacaaattcccccggctgaatggccattccgccgattttaaaccagctttgcgcatttccggcaacatgtccgaaaacaaacagcgcgcaaagcgcagccactgacgcaagcagtatgattttctgaatcttttgatgggcgaacactttgtacggaaaaacggccgcgataataaacagcacaaaccccgcgatgacggcgaacagctgccgtttaaagaaatagtcgctgctcacgccgtaacgcataacggcggtaatcatgcttgagctgtataccattaccaatccgaaactgcacagcagaatgatagcgcatatcaatgaataatcgtaagattttaacattcttttaaacataacatcctctttcctgcttaaagcttacgtttaatacctattgcgtattatattttactataattcataaacaatttacgcagtttctttatagtttttcggatgaaatgcagattaagagaccgtcttacgaaaagaagatgcaaaaaaacggtttacggttataaaaaaacccaaaccgttgaatagtttgagtttgatcatttattttcctgtaaacgcgtcatgcaaagcagacagttctctttcaagtctgtccagcagctctttgccgtcgttttcgtcaactaatcccaggcggacagcaaaatcgatttccctcgacagtccgaacatctgagtatccaagacctcttcatacagaggacattgaggcatcgttaagttatccatttgtactcggatcagcttcaaaatcttctcagcatctaacttcaacagctcgaatgctttctgctgatggtcaactataatctctgaagccaaaagtatccctccgttccccaggcgagtacctaattcttctatttatcataaagggtatcagatgaaattgcaagaggatttaagcagatgttatgataaaaaatgtttcaaaaaatactcagcctgtatttctcagacatgatttccaaaagcttcacacccgcgatgctgttgcctttttcatcaagcgccgggccgaatataccgattccgaagttgtacggcgaaatgcccatgattcctcccgaaacgccgcttttagcgggaatgccgaccttgattgcgaattccccgctcgcattgtacatgccgcatgtcaccataaacgtcttgcagattctcgccacatcttttttaatgacctgctccccggtttccggatgcttgccgtcaagggcgaatacacagccgattttggctaaatccagactgctcatcttaatcgcgcactgttttgtatacaaatccatgacctcttcaacatcgcctttaaaaatgtcatactgcttcatgtaataacacatggcccgattaatcatggaagatttgaattccgattccgcgacatgtctgcaatatgtaatgtcctgattgttcgcaagtcttctgatgaatccgagcaggtaatccaggcggtctttcggcgaatgccctttaattaaacccgtaacgatgagagctcccgcattaatcatcggatttaaaggcttgcccggattcactgtttcaagcttaatcatggagttaaacgggtcgccggtcggctcctgacccacgcagctgaacaccttttcctttccgtaatccatcagtacgagcgccagagaaagcactttcgaaatgctctgcagcgtaaatgtccggtcggcgtctcctgccgtcagacatgtattttccgcatgataaatcgtgaccgaaaggctgtcttgttcagattcagccagagccggaatatagtctgccactttgccttctccggttctttttttcgcttcctgaactaatgcgtccagctcttggtaatgccggcataccatgtcgatcatcctcacttcgctgccgttgtatacatctaatttgcaacgcaaagtgacaattcatgcgaaaacttttatactttaagtaaaggggggcttcaacatgagcgttattcaagtaaaaggcaatgttacatacccgattacaattgatccgagtgtctggattttcgatgaccgcaaatttccgtttgaaaacaatcagcctgttcatcaggacggctctgcagaaacccaggagcatacgcttgatcctgaacgggtgatcagagaagggcgcatttcgccgccgactttaaaaagtgaaaaacgttatgaaaaagaaagactgatgaacggcagcttcgccatgaagctcggcgctgttttagcaaatgccgagccgaaagaaagcgctgtcctgtgcgcatttatttcaaaatcagaaagaaccgaagtgccgcttgaaaaggcgatggacgcaatcgcgcatttcagcgatgcggggaaaccgcttcaagacggcggtccggtccatttttacgtggacggagactttgaaaaaccgataacgggcgtcacagaaatcgaagttttataacaaatcggcggcaagctgtgcaaggccggatctctcacctttcacaagcttcacgctgccggagacggtttgtcctttaaaccgctctacaacataagcaagtccgttgtttaaactgtctaagtatgggtgatctatttgctccggatcgcccatcaggacaattttgctgccctctcccacccttgtcaaaagcgttttgacctcgtgcctcgtcagattctgagcctcatctataataataaactgatccggaatgcttcttccccgaatgtatgtcagcgcctccacctgaatcgatccgattcctgccaaaatcgcttcaagttcacccggctttttcgcattgaataaaaattcaagattatcaaagatcggctgcatccacggcttgagcttttcctctttttcgcccggcaaatatccgatatcctttcccaccgggacgatgggacgcgcgacgatcagctttttataaataccgagatcctccgtctgcagaagccctgccgcgagagcaagcaaggtttttcccgttcccgcttttccgatcagggtgacaagcgggatatcttccctcagcaggagttcgagcgccattgtctgctggacgttcttcggcctgatcccccatacgtgctcatcatcgaaaacgagtctttttacggtctctcctttcttatccgccatgccgaccgcagacgaagatcctcctaattcatctttcatcagcacaaattgattcggataaacctgatgctgctgaagctccttgactggaatttgtttgtttttataaaacgaggcaaaccgctctttattcataaatatatctttgtacccgctatatatttcatgatggtcaacgactctgtcgtttaaaaagtcctccgccaaaagcccgatggcatccgcctttaccctgacaagcacatctttgctgaccaggatgacgaggcggccgttttctttcgtttcctcctcaaggcttaaattttttgccaccgccaaaatgcggttatcattcgttttttcgataaaaatttcttggagctgatgaaatgaccggtggttcagttcaattctgagcgttcctccgctttgaagcggaactttctcgtgcagccttcctttctccctgagcccgtctatcagcttagatacgtgcctcgcatttctcccgacctcgtccatataccgcttttttgaatcgacctcttccagcacgacggcggggatgacaacttcgttttcttcaaaggaaaaaatggcgttaggatcctgcaaaagtacattcgtatctaacacataaattttactcaagtctcagcctcctgaaataaggatcaaagcccatcgtgtgcttctctttccgcgaaaaacggggatgcctgctaaaatatatgatttggtgaataaagatagaaggttaattcaacaataaaataaatgaaagcattcaaggagggaatctgacgtgcgaattcttttcattatcatacaagccttgtttatcctgaccggctgcactgctgtacaggacggccgcggccgcaatatccagaacgaatcaaccgatcagcgtgatgcaaaaccgattcatgtaaaaaatacggctcctgagacagctgaaaatcccggccggacagacatcgctaagcatctcgtcgaggtaaccgaaaaaatccccggcatttcagatgccaccgcggttgtactcggaagatactccgttgtcggaatcgatgtggatgacaatttagaaagaagcaaagtggagagcattaaatacacggtcgcccaggcgttaaaaaacgatccttacggcgccaatgccgttgtcgtggctgatcctgatacggtttcccgtctgagaggcatgggcagcgacattaaagccggccgccccgtttcaggcattttggacgaacttgccgccatcgtcggtcgtgtcatgccggaagtcccgaatgatgtgaccgacaatgaaaaagaatcaccgactcaatcgaatgatgatcagctgaaccaaagagaccagaacaagctgcagaacgaacagaacgatcaatcggatcatcatatgaaaaaccgccagtaaaaagcagcgcccgctccaaaagaagggcgctgctttctttccctttggcaggaggggcatccatgatataatgcttgtcatagtgaaagaggtgaaaatcaatgagagtaaaatgttccatttgcgacaaaattgaacaaattgatgatgaaacactgacagccaaacgcctccgcaatcgtccgattcatacatatatgtgccgggaatgccatgaccgaatcaaaatcaaaacggaggcgcggctgaataccggacacttttcctttcatcctggacaaaaagcgaaaaaagataaactgaaaaaataaaccgcaataaaaaatgacccgccggaaggcaaggtcatttttttattgcggtttagctgactggctttttttggactggtgcagacggattttgtaaatgatcaaaatcaaggcggcgacaacaagcccttctccgaccggcaaaaacacaccgaaaaaagtcagcacggtgcagccgagcacgagaaagagataaactgccgcagccttcaaaaccggcagccgtttggcaaagccgagtttaaatacaatcaccgaaagcacgacgatcgttccgtataacagccacattcccgccagcggatgctcatccacttggtaaagagccgcaaagaacgacagccgttcacttacttcattcaaaaagatccccctccccttttccgttcgggttctaccttttcaaattctgcaagtgattaagacattcctgctgtttttttctttttcgccgctttttcacgttcgtttttattcaggattttctttcttaaacggatggattccggcgttacttcgcagtattcatcctcgtttaagtactcgagtgattcttcaagcgacataatgcgcgctttcttaatcgtagtcgtttgatccttcgtagcggaacgtacgtttgtctgctgtttcattttgctgacattgacaacaaggtcattgtcacggttatgttcgccgacaatcatgccttcatacacttctgttccgggctcaacgaagatgacgccgcggtcttcaataccttgaattccgtaagatgtcgcttttccgttttccatggaaacgagcacaccctgacgtcggcctccgacttggcctttttgcatcggctgatagctgtcaaacgtgtggttcaggataccgaaaccgcgtgtcagtgacagaaactcagtagaatagccgatgagtccgcgtgaaggtacggtaaagatcaggcggacctggccgtttccgttattaatcatatcaagcatttcgccttttctcgcacccattgattccataacagaaccggtatgctcttcaggcacgtcaatctgcacgcgctcaacaggctcgcagctgacgccgtcaatttccttaatgataacttcaggtttagacacttgaagctcatagccttcacggcgcatgttttcaattaaaatggacaggtgaagctcaccgcgtcctgaaacaacccatgcgtctggtgatgcagtcggttcgacacgaagactgacgtcagtttgaagctgcgcattcagacgctcttcaattttgcgggctgtgacatatttgccttcacggcctgcaaacgggctgttgtttacgacaaatgtcatttgaagcgtaggctcatcaatgcgcagaaccggcagcggctcatggtggtcagccggacaaaccgtttcaccgacgttgatgtcttccatgcccgaaacggcaacaaggtctcccgctctcgcttcttcaatttccacgcgtttcaatccttggaaaccgaagattttcgttacacggaatgatttaaccgttccgtcaagtttcatcaatgaaacctgctgacccactttcatcgttccgcggaaaacgcgtccgataccgatacggccgacataatcattgtaatcaagcagcgccacttggaattgaagaggctcttcggcgttatctaccggggcagggacatgttcaagaatcgtttcatacagtgattccatgttttcgtcctgctttttcggatccagacttgccgttccgttaatcgcagaagcgtagacgacagggaactcaagctgttcttcgtttgcgtcaagctcgatgaacaaatcaagcacttcatcaatgacttcttccgggcgggcgaaatcacggtcgattttgtttacgacgacaaccggatttaagttctgctcaagggcttttttcagtacgaaacgggtttgcggcatgcagccttcataagcgtcaacgactaacagaacgccgtcaaccattttcataatccgttctacctctccgccgaagtcggcgtgtcccggagtgtccaaaatattaatgcgtgtatctttatagttaatcgcagtatttttcgcaagaattgtaataccgcgttcacgttcaagatcgtttgaatccattgcgcgttcggcaatattttcgttggcacggaatgttccggcttggtgaagcaattggtctaccaaagtcgttttcccatggtcaacgtgggcaataatcgcgatgttgcgaagatcgtttcgaagtttcacattttcatctcctaaaaaaattagataactttcatattataccacacatcctctttaaaagcgttacgtttttctgtaaactgaaagtatgacgttaaaggggatggaaatatgaaaaaattgaattggctcttattattatttgcattcgcagcagtcttcagcatgatgctgatcggcgtatcaatcgctgagaaaagcgcatggggcatcatcggaagcattgttctcgttatcgccatgatgggaagcggtttcaccgtaaagaaaaaaatgcgcgaacagggactgcttgattaaaagcatgaccctttgcaaaattccgtaaacatggaaagacaatatcttatgaagcctgaatcaaagattcaggcttttttacctcctcaaaaacagactccagatgtaaggcttatctcccccgccgtctagtcaggaagccgggaatgacggcccccattctagttacatcagcagattccctcagaatatacagtctgaaatagtccggcatcgttatgcagaaaataccatacctcctatatcaattccatcattgtctttttatacttgtgactgtaagcaaatacacatgacaaggagagaatgaaatgaaaacatcttttttgaagaaaaccgctgtaactgccgccgcaaccgcctcagccgccttgcttgcattcagtccgcttgattctgccggcgcaaaaacgatccaggcaaatgaaccgcataccctgcaggtttccgcagagaaaacaccggaagacgcggcaaaactcattgacatcatcagccaatcgatttacgaaaaagacggcgtctattattttgacggtgaaaaagcggttgaattgggattagataaagaagccgcacagaccattcaaaagctgtgggacagttcaaccgaatttttaaccgttctttctcaatgtattgagaaaacggacggcgaatatacatttaataaagaaaaagcggtggagctcggatttacggaaaaagaggcccttatcgttgatcagctgttcaccactttttcccaaagtcttcatatccttcaatctgcgctgattgaagaagacggtgtgtatacgtttgatcaggaccttgctgaaaaagcaggagcaggaaaaaaagaagcaaagctgtgtgccggattctttaattcactgcctcaggacttgcttgaaggcatttatacagcctttcatccggctgagtaaacggataaaacgcccggtcatgtcatgcagccgggcgttttttttaatcagcagtttaaagatcagcatgataaagaaaacagcgccgaacaaacaggctgcttttatcagcagcttcccgtaataccgttccttaaaccgcctttcttcttctgcataacaggcgggctccttcatctcggggctgccgaggtcaagcggctccttcatcatatgatataaactttcgcacttaccgcatgattcaaggtggcgggaaataaaccgctccgtttctgtttcacaatcgccttcaatatatatagggagtaaatctctcactaaacagcaagtcatatctgtccgtccttccttttttccgctaagtgctgtttcagctgcattctcgccctgtacagagtgctcttcaccttcgaaagactccagtccaaaacatcagcaatctcttcgtaagacagctcttgaaatatctgtcgaaatgctgaataaaatgactgaaaatctctgacatctgaaacaatccttttcgtttattaaggcctcacctgtttagacaaacggctataaaaaaagttttacagatcggaacatttttcctctattatttctcccgacttcatttgtcatttttttcagaataaatcgcatcattcgactcatgtttgattcaacacgtgcctctcggcttatcccctgacgctgcccgcctgaagcctttacgggacgattctatcaattcatcagcgaagtctagttttatattgcagaatgagagaatgctggtttattataacaatataagttttcattattttcaaaaagggggatttattgtgggtttaggtaagaaattgtctgttgctgtcgccgcttcctttatgagtttaaccatcagtcttccgggtgttcaggccgctgagaatcctcagcttaaagaaaacctgacgaactttgtgccgaagcattctttggtgcaatctgaattgccttcagtcagtgacaaagcaatcaagcaatacttgaaacaaaacggcaaagtcttcaaaggcaacccttctgagagactgaagctgattgaccacacgaccgatgatctcggctataagcacttccgttatgtgcctgtcgttaacggtgtgcctgtgaaagactcgcaagtcattattcacgtcgataaatccaacaatgtctatgcgattaacggtgaattaaacaacgatgcttctgccaaaacggcaaacagcaaaaaattatctgcaaatcaggcgctggatcatgcttttaaagcaatcggcaaatcacctgaagccgtctccaacggcaacgttgcaaacaaaaacaaagccgagctgaaagcagcggccacaaaagacggtaaataccgactcgcctatgatgtaaccatccgctacatcgaaccggaaccagctaactgggaagtaaccgttgatgcggaaacagggaaagtcctgaaaaagcaaaacaaagtggagcatgccgctgcaaccggaacaggtacgactcttaaaggaaaaacggtctcattaaatatttcttctgaaaacggcaaatatgtaatgcgtgatctttcgaagcctaccggaacacaaattattacgtacgatctgcaaaaccgacaatataacctgccgggcacgctcgtatcaagcactacaaaccagttcacaacttcttctcagcgcgctgcggttgatgcgcattacaatctcggcaaagtgtatgattatttctatcagacgtttaaacgcaacagctacgacaatagaggcggcaaaatcgtatcttccgttcattacggcagcagatacaataacgcggcctggatcggcgaccaaatgatttacggtgacggtgacggctcattcttctcgcctctttccggttcaatggacgtaacggcccatgaaatgacacacggcgttacacaggaaacagccaacctgaactatgaaaatcagccgggcgctttaaacgaatccttctccgatgtattcgggtacttcaccgatactgaggactgggatatcggtgaggatattacggtcagccagccggctctccgcagcttatccaatccgacaaaatacggacagcccgaccattacaaaaattatcaaaaccttccgaacactgatgccggcgactacggcggcgtgcatacaaacagcggaattccgaacaaagccgcttacaacacgattacaaaaatcggagtgaaaaaagcggagcagatttactatcgcgcactgacggtatatctcactccgtcatcaagctttaaagatgcaaaagcagctttgattcaatcagcgcgggacctttacggctctcaagacgctgcaagcgtagaagcggcctggaatgcggtcggcttgtaaacaagaaaagagaccggagaaatccggtctcttttttatatctgaacatttcacaatggcttcaccatgatcatatatgtcttttcccgatcgtctttttcaagcttaagctgttcaaagccgcattggcttaaaaacaaaacccattcctgcctgtccaggggaacggctgaaaacatcgctttatgctctcctctcagccggcccgcaatctcttcaatgaccgcgcgaccgattcctttctcttttgcctccggagcgacggccacggttccgagccacggttttccgtttgaaggcgcccattccaaatgaaaactgacggcggcaggagcgccgtcaatctcccatacgagccacgttccattgtacatggagtatgcaagcataaactccgccgcattttttgttccgaactcttcgtttttccacaccgggtgtgatgccgccagctgctccagaaacccgagatcttcttcttcaaaatctctacctgtcagcatgtaaatagtcgtcaaagataattttatgtatagccggattgcccgcaagcacgctgtggttgtctaaaaacgtgaacggttcgccgtctgtggtcgtgtaaatgcccccgacttcgttcagcagcacgcagccggcagcgtaatcccacggcgcgagcctcatcgtaatgtatgcgtcaatgcggccggccgcaacaccggccagctcaagtgccgccgaaccgtaggaacgcgttcctctgacccgttttacgagcggcgccaaaatactcgggtcaatccttctgttttccgtcacccatgtggcattgattgcaataatggcttcttcaatggaagcttcttttaaaggagcaagcggcgtatcattcagataagccccttttccgctgaatgcgtgatacagttcgtcctgcatcacatcataaattaagccgattttgccttttccgtcttcaaagatgccgatggagatcgcgaaatgccgcttttgatggacaaaattcatcgtcccgtcaatcggatcaatgatccagacgattccgtcaagggagcggagtttatccccctgcccttcttctccgagaatccggtgtccgggaaaagttccttgtatacggtcaatgaaaaagcgctccgtctctttatcaatatttgtgactaaatcattcggatttgattttgtttcaatcgtcaagctttcctgcatggattgtctgattctcgttccggcttcttttacccattgttttgcgatatcatcaatttccgtccaatttgtcataccgtgtacctcttttctatgtatagcttattctatagcatactgataaaggcgatgaaaaagcaaggaaaatgaaaaaaatgccttctcacgtaaaaacgaaccatttcctgcggttcgtttttactattctttatccgttaagccgaatccattcttttctgagacgttccagttttcttttgctgagatcgatttgatcttcattctctttttgcatggcctcgtacagggttgccaattcataatcaacctctagtctccagacagctacacggttatttttttcctccctgaatccttccttcaccacttgcctcattgtctttcgccccttccagagatcatttgttaaaaaagcatcccatttttccaattcattaatgatacttcttatatcgtatggaaacttatattcggctgtaacaacattcttaaaattgtgtgtttacctattcgttttttaccaccattcctctcgactcaaacgttctcaatgtttttgcggcgggcggcggctgtggtaaaatatgaatacttacgttaaggaggaaaaagatgactcagatgcgttttacaaaagaagacttcgatacatttacaatagaaggtttagatccgcgcatggaggtgttaaaagaacaagtccgtccgaagctgaccttgttaggagagcatttcgcaccgacattgtcagcattgacaggagatgaaatgttcccgcatgtcgccaagcacgcgagaagatctgtcaacccgccggctgacagctgggttgcctttgccaacagcaaacgcggctataagaaactccctcactttcagatcggtttatgggacacccatatgtttgtatggtttgccatcatttatgaatctccgataaaagaggaatacggcagattgctggaagcgaagcaggaggaaatcacaaaacagattcccggtcattttgtatggtcgccggatcatacgaagccaggtgcgtacaagcagtccgacatggatcaggagcagctgaaaacattatttgaacgcctgcagacagtgaaaaaagcagagcttttatgcggcattcagctgcaaaaagaagacgtgatcaacatgaacaacaatgaattcctgcaaaccattgaagatgcttttaggaagctttcctttttatacacactgactcagaaagtctcataacataaaaagcgggccgattgccggctcgcttttgtctacattttgataatcgcttgatctgattgtttcgcctgtttcacagtccgatacggggaataggtgctgtcagcttcaaattggctgcagattttcttttcttccgctttcccgggaacgatttctttaaagcggcggtacgcattcagaagtctgtctcggtcagctcctttttcataggcgttttccacctgctgaaaaaaagcaatgacatccacggcctcctctgtcgtccagtcctcattcatcggatattgatattccaaatgtcttcactcctttatcatcatgctcaaaaataagcatcttccatagatcataaattgttctttactttctttcaagttcataatataattcatttgttttacgtttaaaaaacgggtaataaaactgaatgtaatacaaactaatccgtaggtattatgataaaggtgggaaaacaattgccgcaacatgaaacacccctgtacagcggactgaaaaagcacgcggacagacagcctgtccaattccacattccgggccataaaaaaggcgcgggaatggatccggaattcagacaatttatcggagaaaacgcgttaagcatagatttaattaatattgaacccctggatgatttacatgcgccaaagggcatcattaaagaagcccaggatctggccgcggaagcattcggcgcagaccataccttcttttccgtacaagggacgagcggcgccattatgacgatggtcatggccgtatgcggacccggagataaaatcatcattccgagaaacgttcataaatccattatgtcggccattgtattttccggagcggtgccgatttttatacacccggaaattgacgatgagctcggaatttctcacggcattacgcttgagtccgccgagcgggctttgacggaacaccctgacgcaaaaggcctgcttgtcatcaatccgacatacttcggtgtggcagctgacttgagcagcattgtaaagctcgcgcattctttcgatgtgcctgttcttgtcgatgaagcgcacggcgtgcatattcattttcatgataagcttcctctgtccgccatgcaggcgggcgctgatatggcagccacaagcgtgcacaaattgggaggctccctgacgcagagctccattttaaatgtgagagaaggccttgtttccaaagaaagagtacagtcgattttaagcatgctgacgacaacgtcaacatcctatctgcttctcgcttcactggatgtcgcaagaaaacgcctcgctacagaaggccgcgatcttcttgaagatacgattctgctggcggatcagacacgggaacgcctcaatcaaattgaaggcatccgctgtgtcggcgaagaaatcactgggtcaaaagctgccttcagttatgatccgactaaattaatcatttcggtcaaaaacctcggcctgacgggtcatgacgttgaaaaatggctccgcgaatcatttaatatcgaagtcgagctgtccgatttgtataatattttatgtattttcacccccggagacagagcaggagatgccgaccgtcttgtaagcgcgcttacagacatttcaaagcaggcttccgcaaatgattatgctcatcagcaaacggaagttctgcttcctgagattcctctgttagcgatgacgccaagagacgcgttttacgcaaatacggaagtcattccgttaacagaatccgcgggacggatcattgcagagtttgtcatggtgtacccgccgggaattccgatctttattccgggtgagatcattactgaagaaaatatcagctacatttttaaaaacttggacgccggccttcctgtgcagggtcccgaagatgccacgcttgaaatgatcagagtcatcaaagagcaaaaagccatccaataaacataaagaagcccgaaacgaaatcgtttcgggccttttttacgctttttactcttcttcaagatgacactggcattgtccgcagcatgttccgtataacgtcgtgaccttctcatcctcaaagtaatgaatcgcttcgttacagtcttggcaaacaattgtacccatctgtcattccccatttctcagaatttgaaaacgcttaatttttacttgttgttattatattattatgtcacatttaatatgtcaactgataaattgtataacacatttattttttacggtctttttatagctcgagggttaatcacggtatatcctttatgacgcaatccttttacaatgtccggcatggcttcagccgtccatttccggtcatgcatcaatatgttggcgccgtcccgcaggtaaggactgctcagtgtgatatcggtaagcgcttttttggattgatatttctgatcccaatcatacccgaaggtccagttcattttcaccataccttctttttttataagtctgtcactgtagtccgtattgcttccgaaaggcgccctgaaaaatgcgggtttctctcctattaccttttcaaccgctttattgacgccaatgatttcttcccgttgtttttgttcggaaagatcttttaagttttgatgagtcattgtatgatttccgatcataaaacctaactcatgaatatgcttaagcgctttcttattttcatcttttttcaaaaaatgtccgtttacaaaaaagatcgctgacgcattgagatcatgcagtttgtccgcaatctcagcggcatgctgatcaggcgcgtcatcgatcgttaccaatgcgatcggttttttctctttctgttcatccattttttccacagaaaaggttttcggattgatatagtaacggggctccgccttctgttttttctcttttgtatgatggttttcccgtttggcatgattggccgcggcttgagaatggggtttgtttgtttgcatcttttcatttgattggcagccggcgagtaagcacatacatatgacggctgcaatggctttatacatgcaatccctcctgatatggttttgcccccagtataacgaaaaaacagcgctctcacgaaaaacaatgtgccttttttacacatcggctgtgcaagttgtcacacgtattatttcttcattaaaaacggtttcaattatataacaattcagtaacaagccttaggtttttcacctctcgtgatacacttaatatagtccttataaatggatgaaccaatatattatataaaacagaggagtaagatagatgcgctaccgtacggtgattcccttttttttgatgctgttcgttctgtcaagctgttcggtttctactgtcattccattcaaaaataaccggatcgacagcattcatcacactcaaatcttgtttttttccgatgaaaatcatatagataaagaagttccttattacgatgcgattcttgatttagaaaagaaatatccccatcatgtcgatcaaatgaaggtttatgacaacagaaagggatgggaagaggaaatcaacacgttccctgcgctgatggtgatcaatcatcggcatgtggtcatgaagattgagggatccgtaaagaaaaaagaggatatcatcaaacctatgcagcatgtgcttgcacaataaaaacagcccccgcttttacaaacgggggctgtttctttgttacatcattattttacgatgtggatcgggcttccgattgctacttcggcagcttccatagtgatttcgcccaatgtcgggtgagcgtgaattgtcattgcgatatcttcagcagtcattccgccttcgatcgccaggctcaattcagaaatcatgtcagaagcgcttgcgccggcaatttgcgcaccgattacaagaccgtcttctttacgggtgatcagcttcatgaagccgtcagtttcgttaagagacagcgcacgtccgtttgctgcaaacgggaacttagctgcaacgacttcaatgccttcttctttcgcctgtgcttcagtgtaaccgacagaagccagttcaggctcagagaatacaaccgccggaataccgaggtaatcgatttcagccggctctcctgaaatagcttccgcagcgattttaccttcgtaagacgctttgtgagccaaaggaggtccgtcaatgatgtcaccgattgcgtaaatgttcggtacgtttgtgcggcactgcttgtctgttttaatgacaccgcggtcagtcatttcgataccgacttgctcaaggccgagctcatcagtgttcggacggcgtccgacagtgattaatacgtaatcagcatcaaccgttttttcttcgccttttacttcgaatgtaactgttacgccgtcaggtctttcctcaacgcctttagccatggcgcttgtatggatttcaacgttgccttttttcttcagtctgcgggtaacgagagaactcatttgtttttcgaagccaggaagaatttcatctccgccttctaaaataaccaattcagttccgaagttcgcatacgctgttccaagctcagtaccgatatatccgccgccgataacaacgagctttttcggaatttctttaagcgccagtgcgcctgtagagttcagaacgcgttcgctatatttgaagtttggcaattcgataggacgagaaccggtagcaatgatcgcgtttttaaatgtgtatgtttgcgcagagttctcatccattacgcggacagagttgctgtctacgaaataagcttccccgtttacaacgtccactttatttccttttaaaagacctgcaacaccgccggtaagcttatttacaacagaagctttccattcttggacttttgtaaagtcaaccgttacgttctcagcagtgattcccatgtcatctgaatgttttgcattctcgtaacgatggcctgcattgatgagcgcttttgaaggaatacagccgacgttcagacaaacgcctccaagagttgctttttcaacgactgttactttttgtccaagctgagcagcgcggatggcagctacatagccgccgggtcccgcaccaatcacaagagtatctgtttcaatagggaaatctcctactaccataacattacgcctccattaaaataagttgtggatcgttcagtaaacgcttgatgtggtttaacgcattttgtgcagttgctccgtcaatcatacggtggtcaaagctgagagaaagagctaagacaggagcagctacaatttcaccgtcacggacgatcgctttttcagcaatacggccgataccgagaatcgcaacctctgggtggttgataaccggtgtgaaccattggcctccggcagaaccgatatttgtgatcgtgcaagaagcgcctttcatttccgcaggtgcaagcttgccttcacgcgcttttgtagcaaggctgttgatttcatcagagatttcgaaaacggctttacggtcggcatttttcactaccggcacaagcaggcctttttcggtatccgctgcaattccgatgttgaagtaatgtttttggatcacttcatctgttttatcatcaatcgatgtgtttaaaacagggaattttttcaaagcggatgttaatgctttgacgacgtaaggcagataagtcagcttgatgccttgatcagcagcaacttgtttgaactgtttacggtgagcaacaagatttgttacgtcaacttcatccataagagttacgtgcggtgcagtatgcttagagttcaccattgctttcgcaatcgctttacggataccgctcattttttcgcgtgtttcagggaattcgccttcaggagcctgagctgctgcaggtttagctgtttcctgaggtgcagctgtttcttgcggtcccgcttcttgagccgctcctccatttgcaaagctgtcgatatcttcttttacaacacgtccgttattgcctgaacctgttactttacggatatccacgcctttttcacgggcatatttgcgtacggaaggcatcgcgatcacgcgtttgttcggatcagcttccgcttggtcctgctgtcctgcgccggtttcttttgcaggctctttaggagtctcttctttagagatatcctgccctgcttcagcagacgactgaacttgagcctcagttttcgcctctcctgaatcatggcttcctttaaattgaagatcttcgtaaccaggtgcgtcaaacgtaataatcgtttgtccaacagttgcaactgttccctcttcaacttttaattctaatacttttcctttaacaggtgaaggaatttctaccactgctttatcattttgcacttcagccagaacatcgtcttcttctacctcgtcgttcggcttcacaaaccattttacgatttcgccttcgtggataccttccccgatatccggaagtttaaattcaaatgccacagttttcgacctcctagttgattaagcaaattttagttatgcatacgcaagcattgaacctagtaaacagactccttcatcataagagaaaaggactctctttaccgtcttttaagatgcctgattaaaattcaagaacttttttcgcagtttcaagaacgtctttatggtttggaagccatacgctctcagcaagcgagaaaggaaatactgtatcaggcgccgcaacacgcagaaccggagcttccaggctcagaatcgcgcggtcattgatttcagctacaacgttggcagcgatgccggcttgtttttgagcttcctgcacgacaattgcgcggcctgttttttcaacagaagcaataatcgtatcaatatcaagcggacttacagtgcgaaggtcgataacttcagcagaaacgccttctttttcaagctcttcagcagccttaagcgactcatgaaccatcgcgccgtatgtgatgatagaaaggtcagtaccttcgcgtttcacatcagctttgccaagctcgattgtgtattcctcttcaggaacttcctgacggaaagaacggtaaagtttcatatgctctaagaaaacaaccggatcattgtctctgatagaggcaatcagcagtccttttgcatcgtaaggagtggaagggataacaactttaatacccggctgctgagcgataaggccttccaaactgtcagcgtgaagttcaggtgtatgaacccctccgccgaatggagaacggattgtcaccggagaagtccagcgtccgccggaacggtagcggagacgagccatttgtcctgagattgaatccattacttcatatacaaatccgaagaactggatttccataacaggacggtaatcttgcaggcctaaaccgagagcgagaccgccgataccggattcagcaagcggcgtgtcaaatacgcggtcctcaccgaattctttttgaaggccttcagttgcacggaatacgcctccggcaacgcctacatcttccccgaaaagcagaacgttttcattgtttttcagttctgtgcgtaacgcatcagtgatcgcttgaatcattgtcatttgcgccatggcttacttcgactccttcgctttgtaaatttcaagttgttctttcaagttgaacgtcggctcttcaaacatattctcaatcagctctgttactttcggttttgattcgccgtcagcctttttgatagcttgtttgatttcttctttggcctgttcaatcactttgttctcttcttcttcagaccatagtcctttgttttccaagaacttgcggaaacgtacgagcgggtctttttgctcccattcattttctatttctttcgtacggtatttagtcggatcgtcaccggacattgtatgaggtccgtaacggaatgtaagagtttcaatcagagtcggaccttcaccgttaattgcgcgctggcgtgcttctgcggttgcagcgtaaacggctagtgcgtccattccgtctacttgaacacctgtaataccgacggcaactgctttttgggcaattgtctgtgcggatgattgcttttctacaggagttgaaatcgcatagcggttattctgaacaacgaagatcgccggcgctttaaatgctccggcaaagttcattccttcatagaagtcaccttgagaagctccgccgtcaccagtgtaagtaatagctaccgcttttttaccgcgctttttaagccctaaagctacacctgcggtttgaataatttgagcaccaataataatttgaggtgataaagcgtttactccctcaggcatctgattacctttaaaatggcctcttgagaacaggaatgcctgatgtaaaggaagcccgtgccaaatcagctgaggaacgtcacgataacccggaaggataaagtcgtcctgttcaagcgcgaagtgtgatgcaatttgagaagcttcctggcccgctgtcggtgcatagaaacctaaacgtccttgacgggaaagagaaattgaacgctggtctaaaatgcggatatacaccattcttctcattaattcctttaactgatcatctgaaagatcaggcattgcgtctttatttacgacttctccttcagcatttaaaatttggaacgtttcaaactgcttattaatagcatcaaattgttttttgctatcaacaattgaagtttttgtctttgcagccattttttaaaccacctcttcttttgatttaacagggttaggataccgtttagccatccgtattaaaaacagtcttatcatgctctgcaattctaaaattaatcattcagaaattcacatagcgcttaagcaaagataatgacgtttaaactgtactaataaaaaaagattttttattagtacaatatgatcaacaaccatagtttacagtaattaaacaaagccgtcaattatttataaccttattttgaaaccgcttataaaacttaagatcatactgcgccaaactgtactataaaagactttaaactgtattataaaaacgctctactgtactataattaaaaaaaattacaaagagtaaattaagttatttaacttcgagggcaggctttgagaaggtgccgcgggataaaaacgggcagttagcaatcgtcccgcctgccgaacaggcgggacgatgcttttgtctaattattcaatacccgcccacacgatattcagcggcgtcagtacggcatgaggatgaaactcggaaatcggagtgaaaaatacatacgtaaaatcttcggctggatcagaaaacatgccgcaccaacccattccaagatgtgagaacgtgccttctgtcatgaaataatggtcaccggccggccacaaattaatgcctaaaccaaagccgccctcctctcttggcgctccgaagaagtaaaaaggaagaccgggctttatttgatttctcagcatggcctcgactgtttttcttccaagcagcttcttatctttcaatctgcctttatttctaaacatttcagctaacttccaaatatcttccaatgaagagtacagaccgcttgtcgctttattcggaaaatacgggtgatgacttttttccagctgtacgcactcgtgctcattgatcacacaaacttcttcttttaaagcatcaggcacataaaaaaacgttctttctaatccgagcgcttcaataatatgctttgttacatactgttcgtaggacatgcctgttactttggaaataatgatgccaagtatgacaaagccggttctggaatagttccatgcttcatccactccgtactctaaaggcgtactgaccagatagcttatccattcttcctcattcgttaagtcaatgccttcagccttttgaatatccagctcaaaacttaatcccgccgtatgagtcaaaaggtgtaaaattttaatgtctccgaaacccggtttatcaaatgcaggcaaaatgagcttgaccggcattttcagatcgagcagacctttttcgacgagctgcatgacggctgcagcggtaaacacttttgtcaaagaaccgatttctctgattgtatcaagctgaaatgtttgcttttctttttgtccgccggtaaattcccctaacgactcagccgcaaaaacctcgcctcctcttgatatcatataactcgcgcattgcagatctccattgtctatcatcgtctgataatggctgttaagagcgttaatttgtttcatatcaaatgccggattgcttattgtttgtttcattgttttctccccctgtactgtatgtatcgttttcatcccttacttactgatttcttgatgaattctgacaccgctttattaaattcttccgggtgtgtgatgttcggaagatgccccgctcccttaattttctttaattctgcattgctcagcagtttcttcagcctttttgtttctttctgatcaactacgctttccttctctcccgtaaggataagcgttcttgtataaatgtcttttaaaaagccgatcgtagaatagccttcttgttgatgtatcttcataaaacgttcaatagaagcatttaagaattgattcctgtataaactttcatattcatgcgattttcctatagctataaaatcatttttcagtttttcctcaacactgctttcagggtcttcttcgtattcggtgtaacttccggaaagaatgagtgtttttactttttcagggtattcataggctatcctctgtcctatcatgcctccccaagaagctgccgcaatgtggatcggccaagcaacccctatctcgttcagcacttcaataaaagtctgagccagcccgctcagtgtaaaatcggcgctcccctcactcagcccgtaacccggtgtgtgtatgacaattacattaaattggtctgcccactccttcatttgttctttccacatgtaagcagtggtagcaaaaccgcaaatcagtaaaattgtttcacccttaccgctcatcaatatttccatatgccgggcattttctgtgttagccagaaaatgaacggtttccgtttcttctgtctggtaaaaagcgatgagtttttttgcggcatcgctttgatcgtgctgaagggctcctttcttcagtctgctccaataatgcaaataatcgtctagatgacgattggaagctgtgccgagtattcggaaaggactttcagcttcttcttccgtaacgattgacgaagcatcaaaatcggctgcaatcgctgaatctcttaccagaggcggtgctgaacgggcggataacggattgaaattattttgtattttttctttttctccgtataacacgatcagctggtggccttggccgagaagcgagtgttcaaaagctttgattccggcagtattttctaatgggtgaagtccgtactcggttttcataatgtcttgaatgccggcatcaactgacatgcctccgtctttccagaaaggccaatttacagcgatggtttttcctgatctcccccctcctttctcatacattccctccactcggcaaaatgctccagaaaacgattggcgtaggcgtaatcagcttgacccaaacttccgatttctgaagagatggaagaaaacaaaacaaaaaagtctaaaggcatatttctgagcgcttcatccaaatgaatcacaccattgacctttgattgcagcaccgcctgagcttccgcgtctgttttattcataatgaaagagtcttttaacacgcctgcactgtaaatgaccccgttgatttcggaataatcagcatgaattttttccgctaaattgatgacctgctgtttatctgacatgtcagcctggatgtaagaaatgtttgccccgtcatatcggatgctgtctaatttttcttccatttctgctgtcattttcgatcgtccggcaatgataacgctggctccgtgatttgcataaataaacgctgaaataatccagccgatgccgcttaaccctccgattatgagatacactccgttttttacaaactttgcggccttttgccctggttgcagcgaagcatctttgtatgctgtcacccgccttttttgatcgccgtcatatttcacagcctcatgatgtccggcacttaattcattgagaagcaaagatgctttttcaatggtttgtcttgaagaaatctcaaccgttttacactttatattcggctgctccgcattaagcgttttaaaaaagcctccaatcgcggcgtaaatcggatttgtatattgatccttgtcatgtacgtacaaaaggttgatgttatcttttattttttgacggatcaacgctttacttaaataaaggattgaataaaagctgtgagtcaaatctaacgctgcctcagtataagcttgttttgacaggtaatgaatgattgacgccggaaacgctccggactttttcatatcatctaacagtctggtgtaatgagcagactgctccggattaaatttataatgcttttcatttaccatttcatattcagcggcggcttccgcataaataacattttcactgccgatgtactttcggatttcatcactcaatgaactgccgaaatcgaaaatcaatgtattttccttaggcacttctccggactttaatggcgattctatccattctttttgtaaatataaagattcaagcatcggcttttcagacggctctttcgtttgcgttttttctttaaaagctgcggccggcgtattacgcacatcatatttttcttctaaataagctgctaaatcatgaatattgttataatcaaaaagcaatgtcggatacaattgtgtatccaatctttcctcgagcattttcgatatatgcagcagctgttttgagtcaagacccagttcgtaaaaagattggtgtttgtccgctttatttggcggcgtgtttgtcacatctccaataatggatgacagctcatctgttaatgttttttgactgtcttggtgctgaactgtatcagagatagagtctgtaacgcgagctccgtatttctcctgcagatattccgtcaattcaccgattgtggagtaatcaaataataaagtcgggtacagctttgaacctaacaacagttctaattttttagataagtctaataactgtttagaatccaagcccatctcgtaaaaggaaatatcattcttcaccgtttcagcaggcttttcaatcatgccggctatctcttggattaaattatttctgatcatttctttattgttcgttacgctgccgacgtctttagctttttgggaatgctccagcctttgtattgatttttcatttctgactcttttcacaccgaatcgctcataataaaaagcaagctctccatcaggcctgtatacttctatgtccgcatataaaatgtctttagaaggcggctgcgttatactgtttttatcaatatacacaaaacaagacccggttgttttatgcagtgcccggaatgtctcaatatatatagggataaacgcatttgttccttcatccggcaagtctgatgtaaggactcccaacaggctgagagatccatccaaaaatgcggggtgcatgtaaaagtcatctgtatattcttttgaaagtccgcttaaactgacctctcccagaatataattttcaccttcatataccgtaccttccaatttcataaaatctttatgaatcaggccgcccctgcgcaaattacgataggcggcttcagcattcgaagtccggacggcccctttctttaatgcttcgattgaaattgtcttttcgtctatcgcattttttcttatgatttccgcctgcaagttgactgacgcttcaccttccgccttttcagcgacccatttcctgcttgttgtttcaacaagccagccgttttcttgttccgtaaactggaaggtgacttttttatcaaaatggactgacgtcgcaacaggttcacggaataaaacatgtttgatttcaaaacttcggggtgatatccctttctcagctaaaaatcgtgttattaaatccagatacgttacgccgggtatcgtacgcacttgatgaaggacatggtctgaaacaatataatcgtcatgtttgactaatacgctgaacctcatgcaactcgacaacctttcttcttttacaaagtaaagaaacagagcaggtgctactctgtttcatcaataatttcaagaagccgttttttattctgtttgatttgtttttttcgatttgaatccggccagtactcttttctgacaaactcggcaggcggcagcggagttctgacggaatgatatgaatcatccaggccgcttaccaaaaggtgggcgtttgttccgccgaaaccgaaagcgctgatgcccgccctccgttttccatccttccagcttctcagttctgtattcggataaaaaggcgacttttcaaattcaaagcggggatttggcgtttcacaattcaatgtaggcggaatttccttatgccatattgataaaatcactttaatgaaacttgccgctccggcggcgcttaataagtgtccgatattggtttttacacttcctactccgcaaaattgcgttttgtttgtgtctcttcggaatacttttgtcagagcctgaagctcaatcggatctccaatcatcgtgcctgtgccgtgagtttcgacgtagctgactgatccgggagtgatatcggctctttcaaatgcatcttgaataacctgctcttgaagcttaggattcggagtcgtaatccccattgtcgcaccgtcgttattaatagctgatgcttcaatgataccgtatatccgatttccgtcagcttttgctttctccagcggttttaaaagaacagcgccaaaaccctctccgggtacaaagccgtttgccctttcatcaaaagtaaaacactgaccgtccggcgaaagagctcctccttctgttaacatcaggtaaggaatttcatccaaaagcagatccgcccctcctgccagcgccatttctgaatcaccgttttttatgctttggcaggctaaatgaatgctgactaatgaagaagaacaagcggtatcagacaccatgcttggaccgtgaaaattaaagaaatgcgacacatgtgaagcaataaagttttgactaagcccgacgatgtggctgctgctttctttcggcagtttgtgaccgtagccgcccattctggaaccgacaaatacgccgactttttttcccgataattctgtttcttcataaccggcatcacgtacagtctgtacactcgtttctaagaaatgtcttatcagcggatccgtttggatggctttctcctcttccatacggaaatactccggatcgaagctgccgattccattaataaatcctccccatttgctgatgctttttcccttttgctgcaccggagagtaatgttcttctatattccaccgggaatcaggtacttctttaatatgattcttcccttttctcagattgtcccaaaattcctctttatcagccgcgcccggaaacttacatccgattccgataacagctatctttgcagtggaagccgtctgcggttctgtatttcggctcgtcacagactgcatatcatgctgattgctgctttgagaatcagtctgttcgatttgttttttcaacggcggcgccgtcttaccgatatattccgcgagaccatgaatcgtgttgtgttcaagaagcacagtagggtcgatttttttctgaatcattgcttctatacgatgtataatgctgacaagaagtatagaatccacaccgtattcctgaaaatccgtatttgggttaagcttttcaaggggtatgctcaattcctcggcaaatacggcagaaagttcactgacaagcccttctgaatgatcaaaagtgccgggagtctcctgtcttcgggccggaaatgaagtcttgccggttttattgatgttcaggagactgtctgcatgaaacactgttccttttttcacgataggaatgatattggccgattttttctccagtgcatgatacaaaatcgccagtccttcccgcgtggatagagagtccaatcccaattcatcatataaaggactcgtcacagtacccattccgacttctttccagctcggccaattgatggacgtgaaatacgttctccccttttgaaaatgataagccgcgaaatagtccatatatgcatttgcagacgcgtaatcagtcattcctttcgacagtttgggtgactgtgctgcaattgatgaaaacagaataaagaaatccagcggcctattattaaaaatccgctccaaattctgaagtccagtgactttcggcccgtacaccgtcttaaattcactcattcttttatgaataaaggccggatttccgccgctgtgcagtccggcacagtgtatgacaccgctaatatctttaaattcaaggcttacttggtgaaagaatgaacgaagcttctcttcatttgtgagagaaccgctgtaatacagatagtcgacacctttttcttcaaaactttgaaacagttttatattgctgactgtcttttcgtcctgtctgccctctttcagcaaatgatcccattcacttcgcaaaggtaatggacgcgtacccgtcagcacgagttttttcactccccgtttcaccaaatcttcagctattgctctgccaatgccccctgtcccgccggtaatgacgatggctttatccgcaggaaatgaaacaggaccgccgccggtatcgattctttcttcttcaaaatacggaacatatctgacgccgctgcggtagcatacttcattctctcctgtacattgcgccctttcaatctcaaagatttgtttcagcttatgcgtttctttcatgctgtctatatctattgttttcacatgaacaaagccgtattccgcagaaagggctttcagaaaagcagctgattctgcacccgtcagctttggtttttccgctttaaatacctgcaagccattggttagttgtaaaatggataatggtgtttccttttttctccgcttaattatttcttgtataaataagaatttaccatatgggatgccgttctgattttcactctggtttccgatatctgagaaatcaaatatattttcgacctgccgctcaccgcccgagaagatctcacagataacgtcgtatgcgtggttttcatctaataaagaacactcaaacatttgatcagagtgttttatatatgaagagtgatgttttatgacaatcagattctcctgatctatatccggacaaatggtgcgggcaattgattctgtgtcttgattcacaaatgcgactgtcagtccgtactcttttgtttcggatggatttacaaacggattctccctccattttttttgcaagtgatgttgagaagaatgctgagggatctctgtcctctcagtcctggacggaacccaataacgttcttttgcaaacggataagtcggaattgagatccgtttacccggctgctgtaaatgttgatgaacggatttccagtcgatatccgccccccaaacccataattgagccagcttttccgcttcaccgttctcaataatggtctttacaaacaattcgcctgctctgccttccgttaacgccttcattttttcagcaaatgcatctgattgctgattaacatatacgcctggaacttgcttgtcaccgcggcaaaactgagataatttatctttcatttctttaagagaggtaccggtaatcgccgctctggcctccatcgcttctctgcccgattgtgtagtgtatgccagatcccgtaaaacgacgctttccgattggccgccttccatcacttcattcgggaacatgtctcttatcgctccggcatattccttcagtaagtattcagtaaccgcttgaatggaggggcaatccgttaattcatacatcgtgagttcaatatgaaacatttcgttaataaaatccgccatccggcttaattccaaaggccctacgccaaattcactcaggtgatcagaaatattaatttcttccggatggatatgaagcaattccgaaacaaacggtttgagtacttcattcaccttttctttcatatcagtctgtttatcctttacttcaggacttagtgaacgctgaataaaatctttcatgttttcggcatactcaagaagacgttcattgtctttggcagataacaggacaatatgcggttcgttctcaacatgttctgttgagacgtttgtttcttcatattcttctataatgatatgaacattcgttcctcccgctccgaatgagctgattcccgctcttctcggaacagttactgtttttccgttttcctgcagtttcggtttcttccagtcttgcaatgaccgctgtacataaaagggagatgctttaaaatcaatatttggattcaacgtctccgcatgtatggaaggaaacagttttttcagtttcatttgcaaaagaacctttgtcaaaccggcaattcccgctgcggcctcaagatgaccgatatttgatttgacagaaccgattgaacaatattgagtgtgctccgtaaattcccgaaacgcttttgttaatccggtgatctcaatcgggtctcccagagcagttcccgttccgtgagcttcaatataactaattgtacgagggtcaatacaagctttctgaagcgcgtcctgtatcagttcagactgaccatttggattaggaaccgtaaaaccgtttgttctccctccgtgattgaccgctgtcgctttaatcagcgcataaatatgatctccgtcccttaccgcttccgccgccggctttaaaagtacggagcccactccttctcccggtacataaccgtcaccgccctcgccgaatgtacggcatcggccatcacttgcaaagaagcggctttgatttaataatgtatatttattcggatgaagtgtaagattgactccgcccgcaacagcaagtgtgctttctcctcttcgtatactttcacaggctaagtgaatggcgttaagagaggatgaacacattgtatccaccgccatactcggccccttaaaattaaagaaatacgatattctgtttgctattgcagaaaatggagacccgacggccagttcatttcctttaagtgattcttcaacgccgaaaaattgatagcttccatatgtgacgcctgcaaatactccgacctttttgcgggtcagatctgaaggtttataacccgcatcctctatggtattgtacactgtctctaaaaagagacgttcctgaggatcaagaaaagcagcttctttcggtgatatccggaaaaataaaggatcaaaccggtctggatttttcagaaaacctccccacttatagcagcttccctcgagcatttccttccggtcatcaggaatttcgcttacgcaatcccgtccattcatcagcacattctggaactctctgatgttttccgcacccggatatctgccgctgacaccgataatggctatatcagcagaaaggggatcggccgcaatgtgctcttttgaaccttctccttcagagcgtgccggcgcttttgtttccactggttttcttttttgctttttttgatatgaaacaagttcagatttgccggccgggttcagcagtttcatcattcgttcgctgtgatgactcaggaaatattcggctaactgcgatatggaatgatattcaaaaaataatgttttcgacaatctgccgatactttgctccagctttttggtcaggcgcatgatcatcactgaatcaatgccgtatttctccaggtattgtttttcatctatgagtgagaccggtaatttcaattcctctgacattatattttttagataactgatgatattttgtcttaattcatcgctttgtaaatcggcatcttcctgccggtctgaatgtaagctgattgtgccggcacgcttcagcacatcctcaatcttttcttttcggcctttcagggcgatcagctgttcagatgattgacacaagctgttctccagagcctgtattccgtcaccgtcatctagcgggtcaaggccgagttcctgtttcatgtaggatattccttcatcgtcaatattcatcccgccggaagtccatagcggccaattgactgacaccaccctttcggcagactcttttgcggtcataactgctgcatactgatccaaaaaggcattggcgaaagcatagtcacattggccggctgatccgaagactgccgatgtggatgaaaacaagacaagtaattcaactttcatttttttgatttcttccgccagccagagcgcgccataaactttcgaacttgtgacttgatcgatttcttcttttgtctttcttaagataaaagagtcacggagtacgccggcactgtgaaatactccatgtaaggtgccgaactgctcttttgcaaaagcaaacatccgttcagcatcactttgttttgaaacatcagatcggatatattcaactgttgaacctgaacttcttaaatattcgatcttttttttctgctcttcagttaaatcagagcgccctgtcaatatgagattcgctttccatttttccgacagatgttttgccagtatataaccgagaccgcccaggcctcctgtaatcagataattttcatgatgtttcagcggctgggttaaatcgaataagccggctttattatagcttttcgtaaaacgtctgccgttttcatagcgcacttcaaaatggatatcccgtttttcgtcacactctctctgatatatatcagctattgctggaagagcggctcccgcaccctctgattgagtgatattgataatctgatagtgaaaattggggtgttcctggtgaacggttttcaccaatccgccgagagcatgatgcagcggcagttgttctttattctgagtttgaaaaatatgcgtcagttttattatctttttccattttaattcaatcagcgcctgtgtaatatacagaagagaaaacaatccgttttccaattgtttctgtatacctcccttactcatgtcagcctgagaatcagaccacaagtgaagaatcttttcgggcggctgataatgatcatgaatgtatcggaacagctttagataatcgtcttttttcacgtggttcatacaaatcgtatcatcatgtaaaacagcaaattcttctccgcggatgacaaacaagagagtgcagtccttaaacaaaccgctcaattcttgtatttgccgttcattttctgcaaaaatcaggagcaatcccgtcaagggtacgctcttcgtactcggaatgaacgattctgtccattccggcttgtaatataaaagaggatggttcgatgcccgtgatttttgattctgaatggatgttacacgggcatagccttcgtcagccgacatttgtcctgtttgaatcagatcaagaatatcgctgatttgttcacgttttccgttcatcattcttcccccattaattgtttcaatacagccttctgatcaatatcattggtttccaattgacgcaggagacgaatgagttcatcgtccgtctgaacagtgtctttttcatgaccatatctgaatctcacatctctgcactccgccagaatgcttccgtttccatctgtaaatgtcatatgacacgttacatcacggctgttctgccggttcactttttgagtataaacataaaaattttgagcgagaggctgatagacatccgccgctcccattccgatcaattccgggaaggtttctccgctgacaaaaaatgcactggcttgaatcgcggactcaagcgcttcaggagaaatcgtaaaattttctctttttgcataaagctcatccggcattgaatgaagcgacagcattccgtaactgtttttcgctgattcaatgacaaaaggcgcttcagccggatgttcagtcatttctgatttgacttcagcaatatcaagcgcttcaggaagcataccgctttcaggcttaaccatatgcgcatttccgctggcaagacgtactttattctcattttttgtgtttgcatatatgtcaaaccgcgcaaagtcacgctcaggcgtcagcgtaatcatcagttcccgtatatctgtcattccgttcatgctttcggtccacaataaatcggtcaatgtttgaactggttgtccaaatgccgccgctgcattgacgatagccatttcagccaaagatgcataagggaaaaaggacacgtttccttcagacagacttagtgcgaacggatgattacggctgatttttttcgtgaaactgaactgatgaaaatcggacgtgttactccccaagaaagggtggcccgtcttactcacatccgctgaaacaagtgcttcccctttttccgctatccaataccgctgtttgatcagcggttgtcccgggatagaaatcctgcgggcattccgattcacctcaaaagtctcccaatctatctttcttccatttacccatttggatgctgcttcggcgtaatctgaacaaacgtgaggcatttcattgtgaacttctgattcgaatgtattaccggtatggctcaggctgcttttttcacccctgatataagctgaaagctcttcagcaatgacctgcccggaatctgccactatcgccagccgttcttccatatgatcgcgtcccgtctgaagtgtataggcaatatcctgaagacgcagtttatgattgttatccttcgattcattttctgatagaaaatcagccataacctttgcatattttatcagccgttgtttgtcttgagccgataaaacaaagatcactcggccgctttgatgatcaaatgcttttggcggttcatacgcttccaatataagatgcgcgtttgttcctcctgccccaaaagcgcttaccccggctctcaaaggatgaacagcatggctgttttgcggaatattccattcagccgctttccgctgcacttgaaaaggaacctgatcaaaatctataaacggattaacaatatcggaatgcagagaaggaacaagctgcttattcttcatttggagaagcactttcgttaccgcagcgattcctgccgcagattctaaatgtccgatattggatttcaccgaaccgatggcgcaaggatggttcaattgataggaatctttcagtccttgaatttcaatcggatcgcctaatgatgtccctgttccatgcgcttcaatataattgacggtgttcggatcaatgtcagctttacgaagcgcttctgaaatgacctccgcctgcgcatccggattcggtatggaatacccgctcgtctttcctccatggttaacggcgcttcccttaatcacgccgtatatttgatcttgatcttctattgcttttttcaatggttttaacaatacggctccgactccctcaccgggaacgtaaccgcttccgtcttttccaaaactccggcatctgccgtcacttgatagaaactgtcccatgctgaggaacttatatttattcggatgtattgacaaattcactccgccggctaatgccatatcgctctctccgcaatgtatgctttggcatgcgtaatgaatagaggtcaatgatgaagagcacattgtatccagagccaaactcggaccttttaaatgaaaataataagacacccgattggcaattgaagaatagacggaagccggcgaaaaagccgctccattttcttctccttcaaatagttgatattggccccacattgcaccgacaaatacaccgactttcatcttttccagcatgtttctcgggtaccctgagtcttcaaaacaatttttggccgtttctaaaaagagtctttcctggggatccataagttctgcttcccttggggaaatatgaaagaaaagcggatcaaattgatcggctccgctgataaaacctccccacttgctgtaagacttccctttcatatctctgtcttcgctgaagaaatcatctatattccagcggtcaggcgggatttctgtaatacaatcttttccgctctttaaattctcccaaaattcaggtaagtcttcagccatcggatactttccgcttaaaccgataatggcaatgtcttgatgccttgtatcagctgtttcatttatttggatctcacggctttcatcctccttgaaggtatcttgaagtgcagattccaatttttctttgtcaccttcaaacacgatcagctgtgatgcgttcatagagagtgaatcttgaaaagctttgatcccattggttttactaaggggaaccataccgattttttgtttcatccatttttcagtttgtttatccactttcatgccgccgtcttcccataggggccagccgatggctactgagacgccggagcgttcttttttccgcctcattccttcacgccactcagcaaaaagatcgatgaaccggttagccaatgcataatccgtctgtccgatattcccgtacatcgagctgcttgatgaaaacatcacaaagaagtccaaaggttcggtttgcagcaagctgtccaataagaccgtcccatttattttcggagcgatcacttcctgaatttcatcttttgatttttgaatcaataaagcgtcgtgcgtcacaccggcactgtgtatcacaccgttgatttctccgaatttccttttaatagtttttatgattcgctctgcatcgcggctatctgaaaaatctcctcttatatattgaacggaagaaccgcctgctttcattcggctgattttgttctttttgtcttccgtcagttcagaacggcccgctaaaataatattggctttcgtttgcgctgcgatatgttctgcaaatataaggcctaagccgccggcccctcctgtaatcatgtatactccgttttctttaaaggagaaatctgagttttgagccggttctgcttcccgtaaggcacggacccagcgcacatttccttcataataaagatcggtttctcccggatgcgcttcagttgattcgcatctgatgatttcagctgtaagagccggcaacgatgtcttgtctgaaactgatatcccgattgtcttaagggccagtttcgggttctcaagcaaaatagactgccctgcgccatggactgaagcgtaaagcggctgatcatttttatggtccgccggataaaggaaaagcgatacaacctttttttccgccttgctgcgcatcaatgcccggctgaaaaagaatagcgggtaagcccctttagaaagctgttcacttattttttccgggccggcaaatgatccttccggccacccgtacaccacggtgtcgggcatttgccccctttttttcagatcagctgcaagcctgtcaaagtgggcttcctccctgtgatctatctcataaattccgtctccgtgataggagaaacgattccctgataaaacgagaatgatctgtgtattttcgaatccattttcagcattttcccgcataaaatgaaaaagctctctgtcatattgaaacagcagacatgttcttttctttttatttccgcaatgcgggtcccaagcggcagccttttgtctccaatacggcgttaaataggtcagagccgtatgattctctccatgatgtagagggaggtctttgtcaacggaagtcttttcgccgctctccgcaaaataatttgcaagtttttgaatcgtcggatactcaaacaataaagtagggtacagttccctgcctgttttctcctccaatgcctttacggcttgcataagtgtgacggaatccaggccttgttcataaaaaccttttaccacagagagtgtttcaggggcagtccctttgatgtctgcgatcagctgctgaatgtctccttctgttataagagcggaaagattttcgttcttactttctttcatgtcaggcttttcagccggttgattttgcgttaagaaataactggacattttttgattttctttaatatacgcggcgagttcccggatcgttttctgctcaaacaggagtgtaggatacagctgttcccctgttttgttttcaagttctttgacaatggcaagcaaagaagcggaatccaggccttgttcataaaaaccaatgtctgtccttatgtcacgcagatctatatttgaaaccccggatattaattctttaaggtgtgtctcaatgctttcgcttcgatctatgattgaatcttttctcatcaggccgtcttttggctgagaagccgcttcagtttctaaacgagtctgcttcagattttcaattaaatcttttgagcgaatatgtttcacagacagccgtgtaaaataagcgatcatctccccgtgtgcatcgtacaaaccgtaactgacttggatgacatcccctgaatcatgattttggtcttgcttctctatgtacacataacacctgtcttccaggcgcttcgtcatacggaaagattcaatatgaatgggaatatacgttttcatccggcttgccggagatccttgtgtaaaatattcgggacatgcctgataaaggatcgatatgatggtagacgcatcaagaaaagtgggatgcaattgaaaatagccggtatattgtttggcaatttggctgagcgacaactctgcaagtacagaatgatcagacgcataaaccttccccagactcttcataaattcaaaatgctctatatcaaccttttttaaatagtcatagcatatctccatatcggcttcacggacggaggcatgtttgatttcatcgatatgaattgaactcatgctttccgggaatttctgcatgagcctgcagttcatattctcatcccagctttcatccagaatccggtcatcttttacctttctgctcttcgcctggatttcccatccctgttccaatccctgaaaacggatgcggatttctctgtcaaaggtgtccgatgttgctacaggttccaaatacaaaatattctgacactcgagttcttcaataggcaaacctttactcagcgccatacggtatatcatatctaaaaatgtgacaccgggtataatccgggtgccatgcacccggtgatccctgacaatatagtccgtatgtttaattgttaatgtgaactgatagttttgattactggccacctgtctcattccttttcttttctttataattctttgaaatcaagtaaaggaatcagcaattctgactcttccttttctggagcttctccattgtcgatccagcattgttccttattgaatataaccggagaaagcgggtgtctttttgtctctccatatcctaacgtgagatggctgtcgctcaatatcatatgtgcgttcgtgcccccgaatccaaaagaactgattccggctctcaaaatcccttttctgggacgccattcttttaaagacgtgttcggaaagaaaggcgactgatcaaatttaaaacgcggatttggcgttttacaatgtagtgtcggcgggagcatctgattttttatggataaggcaacctttataatactcgctatccccgctgcgctcattaaatgtccgaaattcgtttttacgctgcctactccgcaaaattgcgtttcttccgtaacctcccggaacacttcagtcagcgcttttaattcaatcggatctcctatcatcgtaccggtgccatgcgtttcgacataactgagagtatctgcatctattccgccttttttcagggctttttttatcactgcgctttgcgctttcggattaggtgttgtcatccccattgtctgtccgtcattattaaccgcggaggagtcaattaccgcgtaaattctgtcaccttcggcaagggcgtcatcaagtcttttcaaaaggactgcgccgcatccttctcccggtacaaatccatctgccttctcatcaaatgtatgacattttccttcaggtgaaagcgcccgagcctcactcagcatgacgtaaggcttttgatccagcaaaatgtcaaccccgcccgcaattgccatatctgactcttttgacatcaggctttgacaagcgagatggacgctgaccaatgaagaagaacaagccgtgtctacaaccagattcggtcctttcagattaaaaaagtgtgagatatgcgcgcctatgaaattttgtcctatacccacgatcgtattttttgaaggggaacctattttggacataaacgtcccggtgcgcgaaccgatgaaaacgccgacttctttgtttgatacttcttcctttgtatagccgccgtctctcaatgtctggacgctgacctcaaggcattttttgattaacggatcaagctctgatgcctcacttttgttcatattaaaaaacgcgggatcgaaagactcaatatcttgaagaaatccgccccacttactgatactttttcctttttcataggtgtcagagtagtatgaagaaatatcccatcgcgacgccgggacttcacggacactatgttgtcctttcttcaaatttctccagaatgtttctgtgtccggagcatccggaaactcacagcccattccgataatagcgatttgattcagactggttggttgcatttgagatccgctgtcccgtacttcggaagcattttgatttatatgttgctctttattccgaacctcaatattttctgaatcaatttgaggactgatcccctcacttgcaaataactcgttcaaatagacgcccagttgtgaaaaactcggatactccagaaaagccgaaggttcaatttttatttgaaatgcatcttccgcttttttgacaagctgaaccagtaagattgaatcaactccgtaatccgcaaaagacgtatcctgatctaaattcccgtaaggtattttcagctccgcggaaaaaatctccattaacttcctgatcatagcttcattgtcaccatgaccagagatcactttttcctcagcatccgggttatttttagccgcttgaattcttgtctgaagcagctgcttcagcttgaatttctccggatgtgtctttgccggtataaggcatggatatccgtttatcgtcatgatttcatccagcatggaaatacctgtttctgttgagtgtgaaagtaaaccgagtgcctgatatgatggacttgtcacctcgcccatcccaatgtccttccagctcggccagttaattgattgataatatgttttgccggctgcatgctgatacgccgcaaagtaatccataaaagcgttagccgcggcatagtcacttgttccggcgcctaataaaggaaaagcgctcgcaacagatgaaaacaaaatgaagaaatcaagttcgtcatcaataaaaacgtcatgaagtacttgcatcccctgcacctttggctcaaatacttctcttatttcttgatcagatttatgaataaaagccggattcgaatgattggctgcaccagcgcaatgaatcaccccgccgattttgccgaacttcattcgcacctctgaaaagaagcgatgtaatttttctttttccgtgagcggcccggaatacacttccacctgaactcccttttgatccaactcatgcagcagttgtaatttcgaataaagaggtgacttttcatcggtgtcttctaacatgccggctattttatcagattccggaaggtcggttactcccatcagcacaagttttttgactcccttgccggcataatgtctggcaagttctgctccgatccctcttgttccccctgtaataaccaaggtttgatccgtacggcataccggcagaccggataggttccggtttatttccgccgcatttaatttctcgacgtatggaatataacgatcaccgttccggtagcagatttcactatacagcccgtcagcgcaagcttcatctgtgattacctgtctcagttccgccgcagtcccgacatgcccgtctacatctattgtttttgattttatcttttgatactccgcgctcagcattttatatagtccggctgtttcggctccggctaacgacggcttgtcattcagaagtgtctgcagccctcttgtcacatgtaaaacgaaaagctttttacgtgtctttatgatttcctgcagcagtgtcagcttcccgattgtgccggtgcgtgccccgttttgattactccgcaaatctgacaggtcaatcatgccgatgatttccggattttcttctatgactgctagagccgtttttttggcttccccatccgaatgatcccagttatctgcgcaaatgacagcgggttcaatcagaggatctgaatcaaacaattcgaatgcaagccgctcactttcactattagccaggatcatcacctgtcctttcgtaaaagcggaaggcgcagccttttgttttttccacgatttttttaatacatcaaatgataagtcagtcggtgcatggggcagactctgcggtacacctgttttctgtttctgtgctgcttttgcggcaggcacccaatatctgttccgttcaaaagggtatgcaggaagagaaataagcttcggtaattccgcagtgtacatctcttcccattcaacgtctcctccgttcacccagtgaatggccatatctcttgcattttcaaagtgagcggctgacagggcattcttttgaccggcgcctcggcgggcgtttcccctatataaaccgtttaacttatgatctgaccgcaaatacatcgtcagcttatcgcgaagatcgtcaaggctgctaacctcaacagcgagccgctcttccatagcgtttctcccggtctgcgaagtgtacgcggcatcagctagtgacgtttttggctccagttcttttatatatgcatcaatcaagagtctgagccgttcttcatttttggcagaaagcagaataatttgcgtcttgttgctctgtaccgtttccatcttttcttcattcttgtactcttcgatgataatgtgggcattagatcctccagcgccgaaagaactgatacccgaccttctggcttgattttgcggcgtctcccaatcggtcaattcagactgcacgtaaaacggtgtttcctcaaaatcaatattaggatttaagttatcggaatgaagggaaggagcaagctgtttatacttcatttgcatcagcacttttgtgatagaagcaattcccgccgcggcctctaggtgtccgatatttgacttaaccgaaccaattgcacaacgataatcgcttttcgagctgtgcaaagctttggttaaacctgaaatttcaatcgggtctcccaaagatgtccctgtgccatgcgcttcaatataacttatgctgtctgcatcaatccccgccttatcaagagtttcactgatgacgtttgcctgctcgcccggatttggcacagtgtatccatttgtttttccgccgtgatttacagatgttcccttaatcacaccgtaaatcctgtccccgtcagcctttgcggcagaaagcgatttcaaaagaacggccccgactccttctcccggcacatatccgtctcctcccgctccaaagcttctgcagcgcccatcgcttgaaacaaaatgattttgtgaaagtaaagtatatttatccgggtgtaaggataaattcactcctccggctatggcgagggtggattctcccctttttaaactttcacatgcaaaatgaacagcagaaagtgaagaagaacacattgtatcaattgcaaggctgggtccgtgcaggtcaaagaaatatgacacccggtttgcgatagacgaataagaagacaagagcgcctgacgtccctcatcatctgaagcaccggctgcaaataactgatagtggctgtaggtgacgccgacaaatacccctgtcttatgccgtttcaactttttctttgtgtaacccgcatcttcaaacgtgtgccatgctgtctctaaaaataaccgttcctgaggatcaattaactcggcatcacgaggcgaaattgagaagaacagcggatcgaatttatcagcgtcttttataaaacctccccatttgctatcatgacgggcattgtcacctgtgtgataatatttccgaaaatcccagcgctctttcggtatttccgttatacaatcttttccggaagaaatattttcccaaaactgttccacatccttcgccatcgggtagcggccggctataccgataattgcaatatcttcctcggaaggtgcggatggtatgcgggaaacggaaagcttctcccgtttcgccggcgccgaatgatcaattcgctgttcggctgccggtaaaaacgccttcttcaactcatgttgatagtgttcaagaaaatactctgacagctcttcaacactgctgtattcaaagaaaagagtcttagacactcttccaaaatacttttcgagacgggagttaagacctaaaattgttagagaatcaattccgtaacggtcaaatgtatcctcgggtaaaatgctgtccgccggtcttcccgtttccgcaccgacgatctctgtcaatagacggatcgtttgctttttcagatctttttcatttaattgcggcagactgttgttttcaggcacagtctctatctttttatggtcagttgagagtaattcacttattctatctttgtctccgctgataacagccagctgagaagcagaacggctcatactgtcctgaaaagcggcaagccctgcttgggcagataaaagttccagccccgtgtgtcttaaagcctgcagctctgccggaccaactgtcatattccccgcatcccataaaggccaattaatagaaagtgttttcccgggacgtcccttaatgcttcgatactgggtgaatccgtccatacatccgttagcgaaggcgtagtcgctctgacccgcattaggcagaacggccgaaagggatgaaaacataacgaagaaatcaagaggctcttcttcagctgctttatccagccaaacggttccgaatactttaggcgctataacttcttctatgctttctttcgctttttttatgataaatgcatccttaacaagtccggcactgtgcaaaattccgtttaattctccgaatgtctgcttaatgtgcttaattaacgcgtccgcctctttttcctttgaaatatctgccgggacatataaggcttcagcaccgagattttcaagcgcgctcaatttttgcgccgtttcacgggatgccggagaacgcccggttaataccagcttgacttccgcctgtttcgccagatattccgcaaacagatacccgaggcctccggctcctcccgtaattaaatacacaccgttcttttttacactgaaactatgtttctccccatcttctttttttactcttttaagctgccttttataataatgcctcggctcataacaggtaaagtggtccgtcttgcattgattgttccattcaaaagagatgacatctgcaatatgctgctttgtaaacggctcgtcaaacattgatttcagctctgcagccttacatgtgaaattcggattttcggcctgtacggtcttaagaaaactttcaaccgcgttataaatgggctgaacctcgccctcggcattttcatacagaaacaaaacttctgctttcggacaaagtttgttcgccatgaaggcctgaaacatttgaaacaaggaaaacagacttttattgagctgctttcttattgcatcttctgtatttttgaagagcccggcagctaaaaaatgaataatatggcggggtcttatattttgagaacgcagaaccccgcatagcgcatcataatcctcatcatttgcaaagttcattttaaaacgaccgttccggcaatcttcgaaacgctcgccggaagtcacgtaaatgaaaggcgcctcatagccttcaagctgtctcttcattacggtatacatgctgtcgtctttgcaaaaaaataaaattggctctttcgtattcgggaatttttcactgcctttaaattcatgtctatcccataccatttcatatagatgggttttccccaaactcttaattaattccagcccttcttcacgcgtcaggctgccttctttcacctttttcacgatttgctcaatttgcatcgttttttcattcatggaaaagcaactcctctatcagctctgacgtctctttcgtattcatctcacctgtttgtgctttttcaagaagcgacatgatttctccatctgctgtatctttatttgaattgtgaagctcagtgttcgagaaagcctcaatcttctgcgcttcatctttatttaaatgaatccaatgtctgttcttactgaaaggataaagaggaagaggccgtttaaccggtttgagttcctcctcatacaagtcttcccagctgatttcacaaccgatcgtccacaactgagccagtttggccggcttgttttgctgaatcagtgattgaacatatgcatgaccttcggggccgccgaataaaggagcgtacagactatcaaaatccgttacatttccttcataaacaccttgcagtctgctcccctgaatgtaaccgtttaatttttcaagaagatctccggtattcgagcaagtgatcgcaaggcggcattcaaatggttcccttccggtttgcagcgtatatgctatttcttcaagaccgattccggacttttctctaaaattgccgttatacggtttatcagctgatcgattccagacgctgctgatatagcggcacagctcactcagggtcattaattcctgaaatatatctagtgatatttctgtgccgtacatttggtttatataagagattaattcggaataagccaacggatcaaatccgaattccgaaagaggtgtctttgcatctatatttgcggtatctaaacgcaggatacccgctgccgcttcccgaaccgcctcttgcacatcacgttcctgcacctcttgctgactgaattgaactgatagttcttcatgtaaaaacgctgttaactctttggctttaaccatcagcctttcctttgttttggccgatagaacaatgatttgatcccgctcggcagttactgctttatcttgtccgtattcaaattcttccacgatgacatgagcatttgccccgccgaatccaaaggaactgactccggcgcggcgcggaatttcatttccttttcgatcttttaatctggcccacttcatagttttattgacaatatgaaacggtgttccgcttaattgaatgtaagggttcagctccttaacatgaagtgtggcaggcaatgttttatacttcatggatagtaatactttaatcagccccggcattccagaggcgggctctaaatgaccgatattcgtttttactgaaccgatgccgcaatattggtcatgattctttcctggatgcggctcaaaagatccaaacgcttttttcaagccttcaatctcaatcggatctcccagttctgttccggttccgtgtgcttcaatataagatatcgtatcaacaggaatatcggcatttttgtaaacagacgttattagttctgcctgagcttccgggttcggagcggtcaatgaagcagatcttcctccgtgattttctccggttcctctcaggactccgtaaatattgtctctgtcattcattgccgcttgcaatggtttcaataacagaacagctgcaccttcaccgcggacataaccgtcggcaagtttatcaaacgtcttacaccggccgtccctagacaaaataccgagtttatcggtatacatatgcgtgactggatctaagagcagcgaaaccccgcctgctaccgccagctcactttcgccattttgaatcgagcgcacagctctgtggattgctacaagactgcttgagcaggctgtatcaatggactcactcggacctctgaaattaaaatagtgggatacacgattgctgatgagcgcctggctgtttccggttcccgcaaacgcatgcgccccgtccgaatgcctcatcagcagctggcggtaatcattaaattgaatgcccgtaaacaccccgatatgtttgccggacagctttgaagctttgtaacccgcatcttctatcgctttccaggtttcctgcaaataaattctgtgctgaggatccatgagttctgcttcccgcggattaatattgaaaaacgcctcatcaaatttatcggcatctgtgataaatccgccccatttcgaatgtacttcgctgcttcctttgccttcggcgtattttttccaatcccatcgatccgggggaatttcctgaatcgaatctttttcattgattaaattgatccaaaactcatctgcattttttgctcccggaaaaacacaactcatcccgataatggcaaccggctgcttctccggatgatggtcagcctgtcttgctgtctttttttcaaacggaaaacttcgcggcggcttcacggttttccctgcggttttcccggcgtgcactttccttttttcagaaatatttttttctgcacctgtattcccttttgcaacagtacgcagttcactgtttaggaattctgaaagagactttatatggctgtaagtaaagaaaacggcaggtgtcagcttaagcttgtattttttattcagtctgacagctaatgttttcaaactgatagaatcaaagccgagattgccgaaattctctgccgtatccagctgttcaatgttaattttcaataattccgacaccatttgtttcagttcttcaaggacattgtctgcagaacccggtcctctataagaactttcctcttgacgaaccggaagcgtatttactttttgatgcggcagatctttttttgctggtgttgttccggcatccccggtaacaaccgaaatttgcggacagtcacttgccaaaattgtctcaaaagccgctatcccttcttccgtttccaaataatcaaacccggatgcggaaagatatgcgtcttcagcttctttgtttaaatgcattccgcctttacgccacaacggccagttaatcgaaatgctcttgccttgtctctcttgcctgcggctctgttcggatctccaatttatatattgatcttgaaaataattgcccaacgcatagttaacctgtccaaaatctccgaagaccgaagaaatagaagaaaatacgataaagaaatcaagcggctcatctttcgttaattcatctaagcataccgttccttcaattttagcagtcatgccttccgtaaaatcagtcagattcatctctgtaaataaccgatcatcggcatgaccagctgaatgaataacgccttgaatggatccccaagtccgtttcgtttcttctatgacccatcccatcgtcttttgatctgcggcatcagcttgataatataccgcgtctcctccaagcgcctgcagccggtcaatgttatgtcgtttatcagctgttaacggtgatcttcccgtcaatactaattttgcttgatactgagaggctaaatattttgcaaaaatcaggcccagaccgcccaaaccgcccgttatgaggtaaatccctttctgtttcagctgatgagagtgctctgtatgattgaatacatactcctttaatgtcttaacatacctcttgtcatttatatatttaacttcttccgcctgccgttccacgcctgaaaccatttcgttaagacaaaattcagccattttttcaattgatatacgttctgaaaaaccgattgacttcacattctctgcggatggcaccaacatatttgccgtttttaaacagcctgcaagagcgcccgtatacggatcattcatgccttttttaaaagagtgaacaagaagcagagaatgaagataaagagaggcgtcactgcgggcgctcagggcttttaataaataaaaaattgattccaggccgctgagaaggcggtcacccgcgtaaaatgtttctcccgtgtgcaagatgacatcaggagaaaacccttttttctccaattcttcgaataaacgaatataatctgacgtcacttccgggtttatacagaatgtcagcagattttgatcggtctgccgctgatccggcgtgacgagaatgacacggctgtctgattgatttttcagagcttcagccaacgcttcatcttttgcaaagaccagaattgtttttggctccctatctttcatttcaatcagagggtttttttgatcccactcatgctcataaaaacgtacatttttattaggcttttcgccaaaaaccagcccgctcagttccatcaaaatcccgccggcattgtctaatacatacacatcataagccgaatcgctttcttcagtttgttctgcatatacataaacgggttcagtctcatgatcaaaaatcgtacattctttaatattttccggggtctctccggcattttcccccgcaaggtatacgacggcttgatatgcgctctcaatcacttccggtttgattatgcaccctttcggcccggcctttgcttttatctttaaaagcacctgtccgttcctgctgacgcagtgctctgcggctttcagactgtcactgcagctgtatccgaattcggcaagccgctgataaaacgcttcgtacggtatacggtctgcgccctgagacaggaacggctcaagatgaatatttccgttctcgtacgccccgccttctaattcgagccgccctgaggaataaatggataagtcgctctgtttttctatagaatacgatgcaccctgattatccggggttaatacaatccggatctgctcattgcttccgctttgtaacatcggttctctaaaggagagctcagttaatttaataatcggattccctgaagccatcgctccggcagctctcgccatttcaatctggctgagaaacggaaacatttccttgtcttgatactttgtttttatatacaaaccggtatcgcttacattgataagaaacttctgggctttaaaatcagatatattgcatgaaatgtaaggatgcagatcgttatttacgttcatccggcggcttcccgtattttgcgcatctattctgcatagctctttggcaaatggatatcccggtgctgatacccgtctcaaagtgacatctttataaagtgacagccaatctactccattaccgccaacccagtattcagcaatcttcacaagatccctgtttgcggctgattcttcaatttcagctttgttcgtcctttgagcttctgttgtgtctttgccgcttgtaaaaatatgatccctcgcatttccgagagtatagtctgtcagccctttaagcaattcatctcttgtggaggcgataacagccaatctgtgcggcatttcttctctcccggtttgtaaagtaaatgctgtatttctaagtgtttctaatgaataatctctggctgctatttgttcttttgcgcgttttgcatattctgccagcctgtcggcattttttgcagaaaaaacaaataaaagctgttcaggttcttcagccgcgagaggagagatagcttcatccgcaaattcttctaaaataacatgggcattagctcctcctgccccgaaagaactgattccggcacgcctgggaacggatgactcccatttttcggctctgtccggtacataaaaaggtgttttttgaaacggtatattctcattcaattcagcagaatgagtcagtgacggaacaatcgttttatgtttcatttgaagaataactttcgtaatgcccgctatgcctgcagcagcctcaagatgtccgatatttgatttaaccgacccgatcgcgcatgtcttcttatcgcgttcggcacctgaaaatgctttggtcaggccggtgatttcaatcggatctcctaacgcggtgcctgttccgtgagcttctatatagctgatgcttttgggatcaatacatcctttttttaaggctctcgtaatgacctcactttgagcttttggattcggcacggtatatccattcgtcttagcaccgtggttgatcgctgttgccttaataactgaataaatctgatcaccgtcggcaatagccttttttacgggtttcagcagcacggcacctgtcccttctcccggcacatagccgtctcctcctgaaccgaagcttctgcaccggccatcactggataaaaatcctccttgagtcaggagttcatatttatgaggatgaatggataaattgacgcctcctgcaattgcaatttcacattcattcctgattaaactttcacaggcaaaatgaacagccgttaatgatgaggaacacatcgtgtccaaagcaatacttggcccgctgaaattaaagaagtaggatacccggtttgcgattgatgcaaatgaggaagaaacggccgcttcgtgaccaacgctgtacagctgatattggccgtacataacccctgcaaaaacaccgacgttttttctttcaagcgttttctttgcgtacccggcatcttctatggtgtgccaaaccgtctctaaaaacagtctctcctgcggatcaattaattcagcttcggcaggagaaatattaaagaacaacggatcaaaatgatacacatcgtcaataaatcccccccatttgctttggttttttacttcgtcgcccgccgcaggctgatagtgcagcctcgaatcccaccgatcctcaggtatctcagttatacagtctttaccgttcaataagttttcccacagagtatcaagatcatttgccatcgggtaacgtccgctgataccgataatagcgatatcattgtcatgatacttctcctgctgcacctgatttttcatctggattttctgtttcccgttaacatcggctgtctgtttattatcttttttcttctgagatggagtgccgctcccgttttctcctaaccggagtttatgaagaagagtatccctgtgctcctcaacgaaatactgtgacaattctgccgcagtctgatattcgaataacagcgtttttgagagcgcgccgaaatgtttttcaagctcattcgtcatattgataatcataacggaatcaagtccgtatttttccaatgcctcttctgcatctattttgtccgcaggcatcctgaattctgcagcaattatttttatgataaaatcagatgtttcagctgtcagtttctctgaatcaaatgattcgatatttctccctgttccttcatctgcctgaatattgtcttttcgttcatataattgatgaacatgattgtcaatttgctcatctccgtaaaatacagtgaattgcgaaaaaccggaggacaatgcgacggcaaacgcttttttaccttcttctttttctaaaggataaaaacccgcctttttcattgtctctaccgttcgctcatccacttgcatgccgacttctttccacagcggccagttcagagagagagaaatcgtatcagaatgctgggcagaacgcatattcataaaatgatccatataactgtttccgaacgcgtaatcagattgcccgacatttcccaacactgcggaagtagaggagaagcaaatgaaaaagtcaggattttctttctcaacagcatcattcagccacatcgtacccaatactttcggtctgattacctgatcgaattcctctcgtgacttgttaagaaggaaagaatcccggatgattcccgcgccctgaatgaccccgtttacttttccataagaagttttggcttttttgactacatattcggcttcttccttattggtaatatcagcctgaacataaacagctgaagaaccggcatcctccaatcgcctcagctgttttcttatatgatctgaaagcggagatctacctgttaaaacaaggcagcattttgtttgaaaagccaaatattctgcaaaggtaaatcctaatccgcccgcgccgcccgcgataatatatactccattttctctcagcggcacagctccgcttccggaatttttttcgggttcatacgttttgagctgtttgacataacgctgcatgtctttataacggatctctacatctgaaggctggaaatcactcagctcattgcgtatgatatcagctgcgtgaacggctgctattgactgctccatttcaatgctttttgctgagattaacggattttccagctgtaatgtccgcaaaaatccgcttgccgccgcgtaaagaggctgttctccggaaagatgcgaaaaatatccatataacagcttgatcggtttgcggcagttatttttgaagagcgcctgttgtaataaaaacaaagaatagactccgctgtcgcattgttcacgaattgctctctctgttttttcaaacggcatgtctgaccataaatgcaccgcttcccgtatatctgacttctcttcttctataagccatcctaacaggtttatgtaatctttttcagagcgggggtcgatttcaaatacaccgtccccggtttttcgaaactctttccccggcttaaccaaaataacccttgtatcatgcaatgcagcaagttctttactcacatcttcatttttatcaaataataaaaggctgccctcacgccggccgccttttacatgtatgctgagatctgtccgctgccagaccgtctgataatatatcgcctgtccgttaccccctgcggaatgagaaccaagctgctgtatccgctttactccttcttccaaagaaatgatgccgctttctatgtcagaaagtactttttttctaatatgacgggcttctttcataaaaatcttcatcccctttacaaatggcactgccgcaaaatgataaactaatcctgcatatgctccagcgcataatctgcttcttcggcagtcagttcgcccgcttttaattgtctgagaagctcttttactctctcgttctttccattggaatccgctgttgcacgagtctgtgcctccgcggaaaacgtttcttttttacgaatggttacatccttcaaacctgcaagtctttctccttgttcattaagcagctgaatatcgtaaataagctcggattgacctttttggcctgttttacgcgcatatgcccagcattctgctgaaacttttttccgaatcgtaatctctcctattgaaaaaggaacataaacagatgcctcttctcttccgtccgtaatcccgaacaaagattgcagagccccatcaattaaagacggatgcaatgtataattttcaagagcatatgcggcttcttttggcagcaataagtgtgcaaccgcttctgtttttccgccccataaacgttgaatcggctgaaaagcgcgcccatacaggaacccgttttcccgaaaatacttgtaacattcatcttgttcacggacaaaagcacttctgtttatcatctcttgtctgtcgatattctctatatcatcatcaccgtaatgatgatcataatctaattcccccgtcacaaatccagtccttacagcagcatcctcgtcagatgacatattaaataatattttgccgtcttttacggaaatgtgagtgtaaatggtcagactctcttgcaaaagcatggccggtcttgcaaagatcacgttttttaaacgagtgacctctttctttcgatatgaccgcgttcccgctgcgcatgccatttcaagaaaagcagctgccgggagaatgctcttgttttttacgatgtggtcttttaaccaaatctctttttctcttaatgtcgttttaaaaaactgctgttccagagtagattcattcgaatccagaagcgggtgcagtgaagactgctgcggcaatatttccggaaatattgcgctttgatttcgaggcacccagtaagactcctcagcaaatggatataaaggaagcttgaccttttgcggggtatactcttcatataactctctccattgaatatcagccccgaaagaccataattttgctagaagattcaagtcctttgtctccatcatcacttcgaggaatttatctttcatcttttgatcatgaaagataaagactttatcaaaatcttttgtaacattgcctttgtatacgccctctccaattgttccttcagtacagaaagttctcagcttctccttaagttccggcaaatcggaagctacaacagcaagtctgtcttccataggctccctgcatgtctgcaatgtaaaagcgatatcagctgccgaggctgttgtctcccgctctgtgaattgcagaaggcgccgggcgtattctttcagtctgtcttcatttttggcagaaagaactgcggcaaacggaccgcttattgtttgtgtgtccgcatggttttgatattcctccacaatgacatgggcatttgctcctcccgctccgaacgaactgattgctgctctcctgttagaggcgcctgattctttccgccactcttcttctttctgctgaacgtaaaaaggcgtcttttcaaatcggatattttggttcagctgttccgagtgaatggatggcgccaacttctgatgcttaaattgtaaaagaacttttgtaagggctgctatacctgcggcagactccaaatgtccgatattagacttcactgaacctatggcacaaaattgtttatcatccgtaaatttctcaaaagcttttgtcaatcctgcgatctcaatcggatctccgagcgaggtacccgttccgtgtgcttccaagtagctgacggatcgcggactgatgcccgatttcttgaaattttcagcaatcagctcagcttgtgcattcggattcggaaccgtaaatccattggtttttccgccatgatttacagatgttcctttaatcactccgtatatatgatcctgatcagcaattgctttttccagaggtttcaacagaacggctcccgaaccttctcccgggacatagccgtctccgccctctccgaaacttctgcacaatccttcggtggaaacaaaattaccttgactcagccaaaggtatttgctggggtgtatggatacattaacgccgcctgcaagcgcaatttcactttcccctcttttaatgctctcacatgccaagtgaatggccgtcagcgatgatgaacacatcgtatccagtgcaatgctcgggccggagagattaaaaaagtacgaaaccctgttggcaatagatgaaaagaaggaactgagcgcaatcggattgccccgcgcagtttcttctgcgccgaataattgatattgtccgtacatggctccgacaaatacaccggctttcataccgttaagcttctcttttgtatatcctgaatcttcaaacgtatgccaggaggtttcgagaaaaattcgctcctgagggtccatcagctcagcttctttatgagaaatgtggaaaaacagcggatcgaattgatcaacaccgctgataaaaccgccccacttactgttgattttccccttctccattctgtcgggactgtaattcgatctgaaatcccaacgttcctcggggatttcaataatacagtttttccctccggcaatgttttcccagaactcctcaagagtatcggaattcggatatcttccgctcacaccgataatggcaatatcctcccccggctgatccatgctcggtgcaggtgtatccttctgctgccggtgctgttttttactcggattttctcttttcttctgtactcttgttaccggagctgcccctgcggccttaagcactttttctttaaaagatgttaggaagaagtttgaaagctcttcaatgttctgatattcaaaaaagattgttttcggaagatccccgaaagtatcttcaagctttgcaataagtgacatgatcataagtgagttgattccgaacttctcaaaagagtctttcgcatttattttatgagcttggattttcaagacaccgctgatgatcttgattaaatagtcattgactttttctttcgcagcatattccgcttcttcatcgtgttccgccgtgagtgtatcttgatctgctgcagctgtatttctttgaatcgaaagcgcctttatcattttatcccgctcaccttctgcaggcattaagctggtaaatgaagaccgcagcattttcagaaacgcttccagaacagaggaagttcgcatcggagtcattccgtatttttcttttatttgaacgattccactgctgtcgagactcattccgccatctttcaataacggccaattgattgatagtgtttttccgtttcgagagagctgggatcgaagcattgcaaaactgtccataaaatgatttgcgtacgcatagtcactttggccggcatttccgtaagcggaaaaagaagaaaagagaacaaaaaaatcaagatcttcgtcttttgtcagctcatccagccagattgtcccgtaaactttcggtttcagtacgtccgtaaaatcaccgggacttttatttacaagaaatgaatcacgaaggatgccggcagcatggatgatcccgtttatgctgccgtaccgctgtttaatgccgaaaatgaatcgctctgcctctgttcgatctgttatgtccgtccgctgatattcaacaatagagccgctctcattaagcatactgatccgttctttttgatcagctgttaaaaaagaacggcctgtaagtataatcacggcttgattttcattagcgatgtgttccgcaaacagcagcccgagttttccggctcctccggtaatgatatatatgccgcctttttgatacgttacagatccgttatcgtgttccggaatatcaataggctgcagccctttcacataacgggtatatgagtctattaaaatctcacattcatccgtttgaatgcgctgcatttcactgattgcagcatcccacatctcggaaaccggaggatttatgtcagaatcctcgtggcgtatctgtatggttttcgctttaagcttggagctttccatgtttaccgttttcacgaaccctccgacagcttcatgaaacggctgattcagaccgcttgtccaataaatatgcaataacgtaacaggttcgtttcttcgcattaaagcttttgataataaaaagagcgagtttatccctctgcgaagagattcattaacagattcttcagtgaattctctgatttctctattccataaataaagcacgacatcaggtgtaaatccgttttcagccaaatcagacagcagcatttcgacatgatgttcatcagaaggattgattgtgcatctattccgttcaattctgtaatcagaatcgggcgttacaagaatgacacggttatgttctccattcatcatctcggcatgctgaaaaagacggttatcctgatcaaaaatcagcatattccccggtgcctgctgattcggcatatcaatgtgatttgtcctgacccaatcggtcttaaaaaaaatggttggggacggagcttgtgattccggctccgcctttttttccatttgttgttttctgtaagtacgaattagctccagtcctgcatcaggagacatttgctgttcttcaattaaggaaagtatttgtttgatctgcactattttccctccagcagctgataaacttggtcagcagaaagttcaccgtttttcaattgttccaataagaagagaatttcctgatcttcatttttatgacctgcggttaattctcccccggtcacttttctgacagagaagtctttcatgctcacggctacttcgccgctctcgttaataaaatcaatgttatacgtataaaaaccggtttctctcaccgaaacatggcatcgggcagtaagcgccctcttaatgtgaagctctctaagtgaataaggaacaaataagccgtctttctcattttctcttaacaaaaatgcagccgcttgaaaaccgccgtcaattaatgaaggatggagtgtaaaatgtgaaaacccgttcgctaaatgatccggaagctccaattctgccattaactccacatcaccgcgatatacggctttcaacgtttgaaaaccgctctgatatgtcaggcccatacgactgaagcggtgataacactctttccggcttatgaccgttttactgctgcgtatgaactgatcaatatcgacatactcaggattgctgtttatgtctccgaatactgtttcacattgtgtgcagatttgctgcacgccatccgggccctctttacatatcgttgcgttcaacttatcttgtttcatttccaagccggtataaatgtgcagcgtttttcctttatataatataggtctgttccacatcacgtcttttattttatatactttactttctccgcttatttccgcacaaactagagccatttcaagcgaagcggctcccggcaacacacagtctcctgaaacaaggtgatcagtgacgaaaaattcagttccggaaataacagttttaaatgcttgtttctttaatgttgagacattctcgctgattaatgggtgaagacttttgctattaacctcgcctttgttctttttcggagtaaaccaataactctcttttgcaaacggataagacggcagcggcactctattcaatttctcattgccgatggtcttccattcaaactcggctccattggcccaccattgtgcgagcagctcctcctttccgctttgaagagcctcctgaatcatatattcagaaacagctgcacgctcttcagtgttttcgcttataaatacgccattttgcaccttgcttttatcaagaaagctgacgtatttatctctcagctcagtcagactcactgcacatacggcaattctctcgttcattgcttcccggccgttttgcaatgtaaattccatgtcactggcattaacggtcatgtcaccggcaatcacgcgatccaagtactgaaccataagccggatatactcaagtaattgatctttggttttcgcagataaaacaaaaatgtgtgttttaccgttgttttccggtacttctttttgaggttccctatattcctctaaaacaatatgtgcgttcacaccgccgaatccgaatgagctgacacctgctctcctcggcagatcgttgttctcttcatcttttatcggattccacttttgagcggtttctgtgatataaaatggcgtattttccattttgatgtatggattgagttctgaaaaatgggcgagtcccggaagtttgcgatatttaaaagccagtaacactttcagcactccggctattccggcagcggtttcgagatggccgatgtttgttttcacagacccgattccgcagcttttctgtttctcaaaaggaatgtcccattcttgatataacgttttaaatgcctttatgatgctgtttacttcaatcggatcgccaagacttgtccctgtgccatgcgcttctatatatcccgcagtggcgggactgacccccgccttccgccaagcttcggttaataagtccgcctgtgcgttcggattcggagctgtcaaagaattggcgcggccgccgtgatttacagctgaccctttaatcaaaccataaatatgatcaccgtctgcctgtgctttgctgagcggcttaagcagtactgcagccgccccttcactccttacatagccgtcagcgcttttatcaaacgttttgcactttccgtctttggaaagcatacctgctttatcaaaagctataaacagagtagggcttgtcataatatgcactccgcctgcaatcgccatttcaaaatcgcctctttgaatcccctcagccgcacgatggagtgcaactaatgaacttgaacaggcagtgtcaatcggttcgctcggacccgtcaggttcagctggtaagaaatacgattagccaatatacaatgatttaaaccggttgcggtctgcgcctgaacagagacgccattttcattgagacgttccgcatagtccgttgtggcgacccctgcaaacaccgcggttttcgtccctgccagatctgacggcttatagcccgcatcttctattgttttccatacagtctccataaaaattctttgctggggatccattaattctgcttcggcgggagaaatcccgaaaaacaacggatcaaaactgtccgcgcctttgataaatccgcctttttttatttttgttctattgacgtccctgatcggatcgccgtcaaactctttccagtcccaacggtcttcaggaatgtctgtaatcatatcccgccctttttcaattccttcccaaaagtcttccagcgtatctgtttgggggaaacggccgcttattcccactattgcaaccggctcattcatatgtctttcctcttgcctggttttgttttcaggctcaggggaatgttcataggattccggcggaggcgtgctgtacaatgttttttcgtctgctgcagaaaaaggttctgtctcagcaaaaaggatttctccgtattgctcgattacataatcagtcagttcagccagtgaattgcattcaaagaaaatggacggcaataattccgtaccatattgttgattgatttcatttccgagtctggtaaacgtaatagaatcaaatccgtactcgccgaatgaagtctcttcttccatttcctttctgtcaatctttaaaatactggacatcatctttgcgatgccctcaatcagattttctctcctgtctttcgccgcagattcatctgaagaaaaagatccgcagagatgaagctcttcggaatactcactctttaaaaactcaagaagttcattaaaatcagtaagaccgaaaaaatctgacggcatcattgatattcctaatgtttcgtttaattcgttgcccagcattgtaaacataattgaatcaaatccgtattcacttatcggcagttcaaaatcaaattcccgttcttcaatttttaatacgccggtgatgatgcgcgtcaaagtgctttttaaagattcagttattgacagctctttcggttcgtgattttcgtcggcgattgccgggtcactttttccgctgtcaatcgttatcattcgttccagctttaattcattaccgctaaataccattatttgatgttcacaccctgtcattgcttgatcaaatgctgcaaggccttcccgttttcccagaggcagcattccgaaacggtcataaaggaacttctctgaatgaatgtcaatttgcataccgccttctttccataaaggccaattaatcgagactgtttttccaggtttattttccgccgctctcatttccgcaaagtaatccataaaccggtttgcataagcataatcagtttgtccggcattcccgattattgcgctgatagatgaaaacataacaaaaaagtccagaggttctctgtctgtataccggtcaagccatatcgttccgtaaaccttgctggccaggactgaatcgagatcctcttcacgcttattgatgagtaatgaatcttttatcacaccggcgctgtgaataactcctttaacaggacctaatttgtttttgacgagttttatcaggttgttgacattttccttatcagaaatatcggtttttacataaaaaacttctgatccgtttttttcgagctcttttacattgcttacggcttcctcagaaagctctgacctgccgataagcacaagctttattctcccttttcgcacaagatgtctggcaaaaatcaggcccaggccgcctgttcctcctgtaataaggtaaactcccccttcttttacttccatctttttgggggctctgccctttcaatttctgcagagtgtttcacctgcctgattccatctctgtatctgatctctgaagcatcatcgctgatgactgtttctttcacaaggttttttaattcaggcagaccggtgttcagctgtaactgaatttcatcgctgtgtatttcaatatttttaccggacaacattggatgttctaaatgaagcgacctaaaaaagccgctgattgccatttgataaggtaagatttgattgttccttgtgaaaaatacatgtgatatcagaattttatgtcttgggattgttgctaacagagctttcgttacattgaaaaccggcaaaacagcctcttccagcttttcatgaatgttatgctcaattcccgtttcagggctcatcccgattaaaatgacgcggtcaattgtcacttgtctttctttaagaatcgccagcaatttcttatagccttcaagtttgacgctgttcaattcaaaggaatcagcttctttttcttgaaaacttccgccatggcggacaaagatcatgttcaggccgatatctttatatgcctggcggatcagcggttctgatatatcctgacggagtgaaattacaaggcagctgtttaaaccgctgccttcaggctgatgaagcataggggcccgcttccacatatcagagtaatacttagctgaatgccgctcattttgagtctgcggtgcagcccttaatgccttcaacgctaagttttttattttaagacttacagatccgtgttcatccataaatagtatatgaaaccttttgacatcatcatgttgtctttcatcggcagctgtaatgtaagcatagccgcttgccgaaggtggttgaagaatttccagctcacctaattcaaaaggcaaatatgcggtatgatcgtcttcctgaccggacgtaaacccgattgtggattgaaaaatgccatccaataaacacggttccagcagcccgccggattttttatcaatgctctcaggaagtgatattcgtgcaagaacagcattttcatggataagcagctgttttattacctgaaagccggctccatagtccaaaccgctctgccggaagtttctataacactcagcgccgctgattaatcttttctgtccggttaaccagctgtccaatttaaaatgctctgtatgagaggcgtctttatctccgcatgtcataatgtttccttggcaatgaactgccgcttcagattgcatatcggttttcaccacaaatctgccgtctttttgattcggcagcagatctatcattatcgtcttttctttttcaacggttatcggaaccgcccatacaacctgactcagttttatgactgattttccgtacagcctctctcccgcttctctggccgcttcgatgattgccgctccgggcagaaccatattcccatgcacaacatggtcttttaaataatattcagaatctgaaagcgttttataaaatcggcactcaccggcagaaaaatcaaataaaggagctgtaccggctgctgatgttgtttgcgccttatttgacacccacagtctgttttttaagaaagggtaagtcggcagcgcaatttttgccggttttctgccggtgcggaaatcttcccagcttaaactccctcccgatacccagaattcagccatgtcggctaatgtggttctgccggaattgagcggaagatccgattgccgctgtccgcgtttatgattcggttttttccctctgaatatttcgtgatcgtcaattccattataaaagtgatttaatttcaacatcaggtcatcgatatttttcgaaatgacagcaagcctttccggcatggcttcccgcccttcaagaagggtatatgcaatatcagaaaggtgaagcggcttatttgttcccgccggctgtaaacactcgccctgcttatgacgagccttttgaagatattcctccagcttttttgctgattcccgtaaactcagtgaatgcttggctgagagtacgataagttcttcactttcctcacgccccgtttgacagtcagcagcagactcatactcttccacaagaatatgagcatttgccccgcccgctccgaaagaacttaatcccgcacgccgcggatatttgctgtcagaatgtttttcattcgcgggttttatccagtcggcagtttcctgctggagacaaaaaggtgtctcttccagataaagatccggatgcacccgttcagcatgcagtgttgcggctatttttttatacttcatttgtaaaataatctttgtcaggccggcaatacccgcggccgcttcgagatgaccgatgttagatttaatcgatccgagagagcaatatgaaacatcttcggtataagctctgaacgccttggtcagacctcggacttcaatcgggtcacccagcggcgttcccgtgccgtgtgcttcaataaagctgacacttctggcgctccaaccggccgctttaagagctccttgaattaaatccgcctgtgcggcaggattaggcaccgtatagccattcgtctttccgccatggttaattgccgttccttttatgacggcgtacacagtatcattatcacgtatggcatctttaagcggtttaagaataacggccccgacaccttctccgggcacgaaaccgtcgccgccttctccaaaacttctgcattttcccgattttgaaagcattcccatctgacaccggtataaatagtcagaaggatgaagatacaaatttactcctcccgcaaccgcaaccgagcactcacctttttttaaactttggcaagccatgtgaattgccgttaaggatgaagagcaagccgtatctacagggatactgggacccgtaaaatcaaatgtgtaagacactctgttcgcgagagaccacgggaacgaatttggaagtacatcgtttttgtccgtcggtattctttcgccgagcagcttgtaagaattggttgtaactcccgcaaatacaccgacatgtttttcggtctgctttctcaacccttcaatggtatatcccgaatcttcaaatgctttccatacggtttcgagaaatattcgttcctgaggatccatcgcttctgcttctctcggcgatatttggaaaaacaaagaatcaaatgattcagcattctttaaaaatccgccccatttgcaataaattttcccctcatgcgctttagcgggatctggatcatagtaggtctcataattccatcgttctttcggaatttctgtgattgaggttctctcttttgatagaagatcccacaattcttcgatattttcagccccgggataacggccgctgataccgattaccgctatcccgtcaagatgttctttttcctccgccgcagatgcagtggtgttttgttccggcctggcgggggtaatgctctgaatctgttttcctttttcctcccgtgaaaataaacgtcccagccgatccgggtattcttttacaagatgatctgctaaatctctgattgtatgaaattcaaataaaagcgttttcgaaattgctcccagtgactgctccagctttgtgttgcattgatgaatcataacggaatccattccatattcagccagatgcacatcttgatcgatctcttcccgttctgcaccgacctcacaggagatgatattggttaaaaacaaaactgtctgatccaaaatatcgccttgagccaaaggaacggcactgcctgtctctgtttcgtccgtcaaaaatctctgctgcataaattgttcaaagcgttcatgatcaccgcagactgcaatattatgcagctgacccgaagttacaatccgcgaaaaccattgcgttccgtcttcagcaggaagttcttcgagccctgaaccatgaaaaagagacgtccgcccttgacctgacaggttcgcccccattccgatgtcttgccataaaggccaattgattgtcagggtgcggccgctgcgcagagaattttgccgtttctgttcccgatattcggcaaaatgatctaaaaagccgtttgcatatgcataatcacactgaccttcgttgcctgcaatagagacgactgaagaaaaaacggcgaaaaaatctaattcgagcgacttcgttgcatgatcaagattcaatgcgccatgaactttcggagcaatcacctctgaaagttcatgctttgtttttcgaaaaagcagcgagtctctgataactcctgcacaatgaatgacgccatgaagacctgcatgctgatcggtaataccgtcaatcattttttttaccgcttctttatcggatatattcgcctgtatataataaaccttggctttaaagctgttcaggtattctaaatgtttctgcttatctccgtttaaaacagatcgccccgataggataatggtggatctttcagttttcgcgcaatattcagcgattttactgccaatccccccaaatccccctgtaattaaatatactttatctttttcagggtattgaatggtctttctgtttgtttctctctgcttctctaacatccgtgcatatcttacgcagcctctgtaagtgatatgaatatgccgatcaggcgctgtgtttatttctttataaagaatgtcagccttctctgaacatgaaacggatgcagaatcatgttcaaagcaaaccgtcttacaatgcagctgcgggtactcttgttttaccgattttaaaaaaccgttcacaccttcaaaatacggcaatttttctttttgatctgcgctgaatgtataaatgaacgttactttgtttataaggttctcgctgattaaagccttagtcagataaaacacagaataaattcctgatgcgagtgtttcttccagttcaggctgtttttcagaccaagtatgcaaaattgcatcgggcgctgcgcctttttcctttaacagacgaatgacaccttgataatcttcgggacactgcctgttgatggtgaaaacactgtcgcttatctgctctaaacggtcaccgggcataataagatatgcggacgtattctctctttttttcagctcttcaaaatagtctttattcccggagaacaacaaaatagtacaggcttgtccgctgcccgcttcattctcaagtgcggtttctttccataccggcgtataaagtgcctgattcttcttttctgaaaaagccgcgtctgattttaccggctgagggtttaaagaaaattgagagcgctcaaacggataaggcggaagcggggcttttcttttatgataatcacctagtttcgcccattcaatctcttctcctgaaagccacatttgcataaatgaatgataaagagcctcatcagctggtttgtccgcttcaaaagcagccgctttgtttagttttgctgatggagggagcgatccgaattgaaaaactgaaaaatcagagatattcacatccggctccgttcccttttcttccgtgtgaagcggcatatggtcagctatctcctgaaacacggcatccatctgattgtattctgtcatcagcggaaaacgggccttatcataaaaacctgccggctgctcattcatacaagcaacagcctgtttaattccgtcttgctttttcaataacatgctcagaaaaagttctttagacaagattccttcatccagtaaatttaatatttccagaacataatcattatcaaagaatccatcataatctgttaaatcccatctcttatacagtcttctcatagaggcaaggatagccatgatcgccgcttcctcttcagccggcaatgcgtttcttttatccgccgtgcgattcacaatataagataaaatctcgatttcctgagtctttcccgctttatcccactcttctaaaaaccctttaaacgtatattggtgctcaagaagcagccgtgttttcccgtacaggcggtctgtaaaatcagccgggaagctcagaccgttcagcagcatccttacatattcttcatttaatcgaaccggcgggtacgtttttgaagtgtacggattgacaaatggaatggacggcggctcgcaggataagtgcgaaggtttttcagcgcctgtgatgacagaaatggccttttcaattttgatgatatccgctgctgcaagagcgacgtaatatccgtctccggcgcctgtaatgagacttggcttaaaaccggatgccaggatactttttatgatttccgtattgataactaaagaatacaagcggattttctcaggcgtccattttcttttaaatgaactgtgcaatgctggtatacccttcagcaccgaccttacgttcttttctagatcagggaacacgcgtttcaaaacggcaaattgtttataactttcccatttgaagtcaccgatggcaagcgcccattcagaatcatgtttcctccgaaaacttaatccctctttaagctgatttttaaattcctccttgctgcctgccaataaacccgccctgtaatcaaacgatgtccttgttaaaagggtgctgctgatcgcttcatttgatattttgcaaaattcctcagaatcgtcagaaaaggttctccaattatgtatcatttgtttcatgctttcttcacttttagcggaaaaaaggaagggagcccttacctttctgtcagtttcgtcatttgtatgtataaattcttcgatgatgacgtgagagttaacacccccaaaaccgaaggagctgattcccgccctgagcggagccccgtctgccgccttccaatcacttgaatcaagcgccggcctaaacggtgttttttcaaactgtataattggatttaccgtatgtacattcaggcttttcggcaccctccgatgtttcatcatcattagaacttttatcaatccggccattcccgccgctgcttctgtatgaccgatatttgttttcacacttccgattctgcaatattgagtatcctcagtatattgccgatatgcttttgtcaatgcttctatttctatcggatcgcccagagatgtacctgtaccatgtgcttctacataagaaaccgtcgcagcatcaacagcagcgttgtgtaaagcttctgagatgacccggcactgcgcttctgctctgggagcggttatggaacgggatttaccgccatgattaacagccgtcccttttatgatcccgtatatatggtgaccggcttttactgcatcaccaaggcgctgcagcaatacaacgcctgccccttctccgggaacgtacccgttcgccgctgcgtcaaaggttttacatttgccgtcaggactcagcattctggctttagaaaaagaaatatattttccgggttggaaattcaagtttactcccgatgcaattgcataatcgctttcttttgtccgcaatgacttaaccgcttcatgtaaagcaacaagcgacgatgcacaagcggcatttacagacatgctttttccggtcaaaccgaatgtgtatgaaagccggttggagagcatagcttcgaaacttcctaaacaggcgtaactgtcgatttccgattcatgacctgtctgccggtagtcagaattcataatacccgcaaaaacagaagtggttttacgctggagatcccgcaaagagaccccggaatcttcgatgcaccgccaagtttcttctaaaaggattctttgctcaggatccatgtttttcgcttcccggggagagatattaaaaaacttatggtcgaaatggtcagctttatgaataaaacctccccacttgctgattgttttgttcggtatactgatatcagctgagtaataaagatcgggatcccaccgttcaatcggcacttcccggatggaatctttgccgctatttatgttttcccagaattcatgataatgatctgcatcggggaatctgcaagcaaccccgattatcgcgatatccgcactctgtttattcaaatgaaccattggcctccacccgcccctttttagtgtagaaataacgtatccaatctgcgtcttagcagactttcggtctcattcatcattttttcaccaatgtcatcgacatgtctgtttctccatgattccaactccgtgccctttacccaatggttaaaagcgcctaaagacgggccgcaatgaacttggaaattcaccttttgttcttcctccccttccaaagcaagcagacatcctctctgcaaataccacttaaatagtaacagcatcttatatttttgattgcgctccgctttttgggccaggttcggctgtttttctattatgctttcgtagatttcatcaaaagtcttattaaaataaacattttcgagctgaatctttgtctcttcatctatctcactcaaagactcatattgttggtagatttgaaataatttatttgccctgaccggaaacagcgtgccctttttcagcacctgaacctttgttccgaactcaaacagagtctccgaaggcgcataagcagtatcgcatatttctgtctcactcagcatttctttaacaaaaccgcttgttgcggcttcaactgtacattgattaatggatcccgtcataataaaatcagcgcccattaaaaaagcagacgccgcagactcgggagttccgattcctcccgcggccccgactctgatcttccttgcgtatttatgtgtttccatcatttcatcccgcaggttaacaaaaaacggcagcatcgccgtcaatgagccctgttcggtattactgccgcaatctgcttcaataatgatatcgtctgctgacggaacacggctgagccactccgcctgctcttccgtcagcataccgtgctgacacattctctttacgatactttggggaggcggactcagaaatgcggccgcaacttccggccgtgaaactttggcaatgatccgattatgaggtatgaccctgccgcttttgtccatcttcaactgatgcgctttgtaataaattaatggcgcgctgacggaaagatacgaagacgcttctattacccgtacgtcatgcttgatatataaatctatcaattccttttctctatcttgatgatccggctcaaatcgcagattcattccgtagggctggccatttttgagtgtctccttaatagaaataagggcctgttcaatttcccttatagttaaacccgctgtgccaaagaaccccagcattcctttcttcccgaggcggatcagcatttcagcggaagagatccctctatgcatcgcacctgccaaatacgcgtatgtcaaaccgtaatcttctttgaaagattgatcacccaatcgggacaccggtgaagccgcaacgctttctatattttcggccatgaggcccttctctttcccgctttcggaattgtccttgttcccttcagaaaacaagagactgtcttttggcgcactaatattaagcggttcctcatctctttgtatggtttgaattaatttagtcagaatgtttccgggaccgatctcttcaaacacagtgacgccttgtcccattaagtacctgatgctttcagtccatttcaccgagtttgttatttgttcaattaaattccgtttgatatcttcttgtttataaggtcttgccgtatagttagagatgaccgggaaattcaattcagaaaaatgaaactccccgataaattccgcaaattcacgctgtgcactttccatgaaacgagaatgaaaagctccgccgacttgcaatacgatataagctttcgccccttctttttcaaaaaaagaggctgcacgctttatctcttctgcagcccctgctatcacaatttgtgaagatgtattgtaattggcgatatctatttggccgaattcatacttttgaagtatttttttatgtgatgctcatccagtccgatcacggcagccattccgccctcggaagcctcactcattaactcgcctcttttagcaaccagccggagacctgtttcaaaattaaaaacaccggccgcaaaaagcgcagtatattcacccagactatgtcctgcaacagcatcagggcgagtatgaccttcttttaaaccctttaaatattgcagtgcgctcactgtataaattgcaggttgtgtatacttcgtatcagtgagcctctctttttcatctgaaaggcataaatcctttatggagtatcctaaaatatgatctgcctttttaatgagctcactgaattcatcgaataagtctctgcccattcctttaaactgcgctccctgtccgggaaagacgtaagcaagcatttgttttcctccttgttccgtatttctgccgtttcttttcgttccgattgtgatttgtttaacatttttcacttcaatttttaaaattgtcatttactctaagcacccggcaccattacttaataagcattacgaagcaaaataaaaaaacctttatgccggataaaggtttaaaagcaaaaagcatgtacaaagatcatattgccgcaaataatagatagaattttctgataattaaaaccgcattttcattctgttttttatatatcaatataataaaaacatcccaacgtgccgaaacaacgattggttttatgtgaatatttccctaaataaatactataccatgatttacatgttgtcaatgggaaacacacgtatataccaattcttcagccgccatttacaggcggctgaactcggttgttatcagttcatcagcccatgccgatatgccttcactatactattcgcggaataatagttctttctctttgttgtagtctttagtaaattgattgaactcatctgcttgtttatgcactttttcgtaaactgagtttactttgccgatttgctcttccagctgcgataatgtgagctttttatctttaatcagtttataaaggtcctgatcaagtgaaatggctttttcgtactttttgtacaaaagatcataagatgcataccttttttccattaaagcgacagcatgcccggctttttcttttactttcttatcctttatttcttgagaagttttttttgcggattcaaatgctttttttgaatcatcaatactgtctttttctgctttcagatgtttttttcgctgatttgcattgctcagagcctgatcagacagtgtgacgattttcttgtaatcatccatattcagtttaaccgcgctgtcgtaaagcttgtgctcttttttctccaatttttccaatgttttctgctctttttgaaacggtttttccgcttgaacggctttttccatcgagtcatgaagcgattcaaccggatcttttcccccgcagcccgcaagcagcatacttgcggcgccgagcgctccgattcctgctaatacctttttttgaatcatattcacttaaaatcccccaatcttgacaatttccactatagaagcccgaacgctttttgacaatagctgagctgtaattggcatgaccgggtaaaaagatgcttacggtgctgtcaaagaatacttgcgtaaaaaattgagaaaacagggcggatgaccatacatctttttggcttttacatagtttatagtagacgccggccctgctgacaaagggtcagcgtaattaaaagaggaggtttttttatgtacggatatggatttggcggcggatttggcggcggatttggcggcggttgctgcggcggatacggttatggcggttacggttatggctgcggcggcggatatggccgcacattcgcattaatcgtcgtattgtttatcttattaatcatcgtcggtgccgcttatttaggctgcggctgctgaccttatacaccatgaaaatcggccggcctgctatggccggccaattgtttcgttgcgccgcgataaagaaattcgctataatttacatattaagctttaggagtgaagtttcttgattactatggaaaatattgtacgcgacggacatcccgcgctcagagagatcgctgaagaggttcagcttcccgcttccgacgaagaaaaacagcatcttgctgatatgattgagtttgtgaaaaacagccaaaatcctgaattagccgagaaatacaagcttcgtccgggcgtcggtcttgccgctccgcaaacagacgtaaaaaaacggatgatcgccgtccatgcagaagatgcgaaaggcactttatacagctatgctctttttaaccctaaaatcgtcagccactcagtggaaaaaagctacttgacgagcggagaaggctgcctgtcggtagacgaacccattcccggctatgtgccgcgctacgcccgcatccgcgtaaaggcggtgacgcttgaaggagaacagattgacatccgcctcaaaggttttccggccatcgtgtttcagcacgaaatcgatcatctgaacggcgtgatgttttacgatcatatcgataaagaaaatccgttcaaagaacctgaaaacgccattgccattgaccgttaaaaaaaccggcacttcccaaagtgccggttttctttatttcaaaaggcccagttctttgacggcccagctgattccctcttcatccaccggctttgtgacgaaatcggcggcagcttttaattccggaaccgcatttcccatcgccaccccggtgccggcaaaacggatcatctcaaggtcatttagtccgtcgccgaatgcataagtgtcacttacgccgtacggaagccgctcaagcactcttttaatgccttccgcttttgaaccgcctttcggaagcacatccgttgacaattcatgccagcggacgtaatcaaactccggaaaagcggcatatgctttttcttcatgtccgcggcagaataaaagcagctgataaatttcttttcctttataaaatgtttcatcaacttcgggataaggcgctttcagactgccgataccttccgagacgtgcggatgtccggggacggtcgttttcatcgtgtcttccgccataaatacgacggggtgctccccttctgccgcctgctttaataaacgcgcaaccgcatcttcaggaagcggatttttataaatgacctcaccttcaaatacgacatactggccgttgtatgaaataaatgattcaatctcaagctcttccagaatcggttttaccataaacggggaccttccgctggcgataaaaacgtgatgtccagcctctttaagcgccgtcacggcgtttcttgcgctatcgggaatatgtttatcatggtcatagatcgtgccgtcaatatcaaaaaagatcagttttggtttcatgtcaatttctcctttttcccgtttatcagtcgtgtctttttcaatatcatcatacagaaagtttttcttccggaaaaccgccttgatgaaattccagttttacccacgaaaacaaattcattttttccgcatactactgctataaagggctttaaaggaggtatacgatgctgcgccgattacggaagaaactcagaagacagtggggcggaatgctccggaaaaaagtcatcgcatagaagggatctttcggtttttgaaagtcccttttttgctcgagactttccttataatccgttttcgaatataatagaatcagcgagtctaacatacggcatttaaggagagatttggatgatttataaggtattttatcaagagaaggctgacgaagtacctgttcgggaaaaaacagattcactttacattgagggcgtttcagaacgggacgtcagaacgaaactgaaagatcagaaatacaacattgaatttgttcagcctgtggacggtgcttttttagaatatgagaagcagagcgaaaattttaaagtattggagttatgagcggaatgaaatttgtaaaaaatgaccagactgccgttttcgccctcggcggattgggcgagatcgggaaaaatacgtacggggtgcagtttcaggatgaaattgtactgattgatgcgggaatcaagttcccggaagatgaacttctcggcattgattacgtaatccccgattacacgtatttagtaaaaaatgaagataaaattaaaggtctgtttatcacccacggtcatgaagaccatatcggcggtattccgtacctgctcagacaagtaaatattcccgtttacggcggtaaactcgcgatcggcttacttcggaataaacttgaagagcacgggctgttaagacagaccaaattaaacatcatcggtgaagacgacatcgtgaagttccgcaagacgtctgtatccttcttcagaacgacacacagcattccggattcatacggaatcgtcgtcaaaacaccgccgggcaatatcgtacataccggggactttaagttcgatttcacaccggtaggcgaaccggccaacttgacaaagatggctgaaatcgggaaagaaggcgttttgtgcctgctttctgacagtacaaacagtgaggtgcctgatttcaccatgtcagaacgccgcgtaggcgaaagcattcacgatattttccgaaaagtggacggcagaattatatttgcgacattcgcttcgaatatacaccgtcttcagcaggtgattgaagcagccgttttaaacggcagaaaagttgccgtattcggacgcagtatggaatcggctattgaaatcggacaaaatctcggttacattacctgtcctaaaaatacgtttattgagcataacgaaatcaatcgtatgcctgccaataaggtaacgattttatgtacggggagccaaggtgaaccgatggcggcgttatcacgcatcgctaacgggacgcaccggcagatttccattaatcccggagatacggtcgtcttttcttcctctccgatacccggaaacacaatcagcgtaagccgcaccatcaaccagctgtaccgtgcgggcgcagaagtcattcacggttcattgaatgacattcatacatccggacacggcggacaggaagagcagaaattaatgctccgcctgatcaaaccgaagttctttatgccgattcacggtgagtacagaatgcagaaaatgcacgtcaaactcgcgactgattgcggcatacctgaagaaaactgttttatcatggataatggcgaagtgctggccctcaaaggcgaagaagccgctgtggcaggcaaaattccgtcaggctccgtttacattgacggaagcggaatcggtgatatcggcaatatcgtgctccgcgaccgtcgcattctttcagaagaaggccttgttatcgttgttgtcagcatcaatatggacgactttaaggtttcggcgggacctgatttaatctcaagaggttttgtatatatgagagaatccggtgatttgatcaatgacgcgcagcagctcatttcaaaccatctggagaaagtaatggatcggaaaacaacgcagtggtccgaaattaaaaacgaaattaccgatacgcttgctccgttcctatacgaaaaaacaaaacgccgcccgatgatccttccgatcattatggaggtctaaaaaaactgcactcattacgagtgcagtttttttattgcagcggaatatgctgaaaggctttgacatcaaacagaccggccgccgtcattttaatatccggaatcaccggaagggctaaaaacgataaggtgagaaacggattgaaatcaccggtgaatccaagcagaggaagcttttcatgaagcacgcccaagctgtcattaacccattccgccgacttatcagacaaaagcccggcgatcggaagcggaacggagtgaagcaattctccgtttttcacggctgttaatccgcccccggtgtcacggagcttgttgattgcttttgccaaatcggcatcgtttgtaccgacggcgatgatattatgggaatcgtgagaaatggttgtggcgatggcgccttcttttaacccgaacccttgtacaatcccgagtcctatcattttttcgccgctgtgccgctctgcgacggcgatttttaataaatcattatctgtatcaggtcgaaacgcgtcagcagacggtgcaggcacttctttttttctcgtctccaaatgattcggtatcatttcgattacattcattttcctgccctcttgaatcggtatatgaaaatccgattcagtcagcggcgctttcagccgcactgtatccaacagtgcctggtccggcgaataggaaccggcagactgttcataaaccgtccgtccgttctcggcaacggtccggccggcgaccatggtcttcgtgacggcagcctcccgtacatctgaaatgaacagcagatctgcgtcaaaacccggcgctaccgccccttttgtttcaaggccgtagcactcagccgcatttaagctggcgagctgatacgcaaggaatggatcaagtcccgcctttatcgccattttgacttggtggttcacacttccttctgtaagcagatcatctacatgcttatcatccgtacaaaagaaaaagcggcgcgcgtttttttcattcaccgccggcagcacgttgagcgtattttttgccaccgatccttcgcgcagcatgacgtacattccccgtctgattctgtccagcgcttcttcttttgtcgtcacttcatgatcatttgacaccattgcggttctgtatatattgatgatatctgaagacagtccggctaaatgcccgtcgatccgctttccgtgacgcttggcatcaagcagtttctgaagcatatcctcttcaccttccgcaacagacacataatccattacttccgcaagcccgagcacctctttctcctgataaaaaggctttaaatcctcggcttttaatacagctcctgagcgttcaaagctagcggcgggaacacaggaaggaagcatgaaacggatgttcagcggcgcctttttcgcctgctctatcataaatgaaatgccttttgctccggaaacgttcgcaatttcgtgaggatcagtaatgacagtagtcactccgtgagggaggacggctttagcaaattcaatcggagtaaccatagaggactcgatatgaacatgtccgtcaataaagcccggaacgatcatttggccttctgcatcaatgacttcttccccttcatattcgcccagcccgacgatcactccgcccgtaatggcgatatctgcagaaatccattcctggttaaatacatccatgatttttccgtttttaatgacggtatcggctttttgtctgccggctgatgcattcagccgttcagccagtgtttctttgttcaaaatgcggcctcctctttttctttatatggtacaatatgctatcggatcgcctgatcatagtcaataaaaattgcagaatataccgcttacatgataaatgtctttctattctgacataataaaagaccgtccttttacggacggcttttcactttgtatgaagcactcttttttcaaatcgggaaatgtccgtaagagagccgataacgatgagaatatcttctttttggatcatttcagtcgccagcggagatacgatcacttctttttctctcttgatggccacgatattaatgccgtacttcgcccggatgtccagatcaagcagtgtgttgcccgcaagcctgctgttggccacgatctccacaatgctgtgttcgtcggacagctccaaataatcaagcacattatttgatacgatgttgtgggcgatgcgttttgccatgtcacgttcagggtggacgatgtgatcggccccgattttcgcaagtactttctcatgataatcgttctgcgctttaaccgtgatcgtgttcacgccgagttcctttaagatcagcgtcgttaaaatgctcgcctgtatattttcgccgattgccacaatgacgtggtcaaagttgcgcagccccaagtttttcagcaccgattcatcggttgaatcgccgatgaccgcgtgtgatgcgattttggcgtattcatttactttatcttcatcaatatccatcgccatgacctcaaggccttcttcacttaatgctttgcaaatacttccgccgaagcgtccgagaccgataacggcaaactcttttctcataacagtactcctttaaacaatatctctaataggaatagtatcacattttcggcaatgagttcatatagcgtttaagcttttctgaaaaggcgggtgataaatacaggtccgctccgcgttcgatttcttcctgatagtgacccggaggcgcaatttcctccgctttatcaagaaccagaaacgtcaggacgcctctgtatacacggccgccggcacacacttctatgaacgcgggacggtatgtgtgattatcaacaccttctcttttgtacagataggttgccgcttcaaacgggagcttgtacagcacgccttcagttcgtcccccgtcttcaacaagatcggctctggaaccgtcaggacgccttaacgtgaatctcgtcgaatacccttcaacaaccgcccctccgaccggctcggcaaagaagtggtcgacccccgcctgtttaaaccgggcattgtccatacaggagccgtaagcgaaataataaaccggactgtcatcctcccgtttcataaaacggtattctttccagtctccgcttttgatacggctgaatgaggcacactggccgggctttacgacatatgcgaaggcggttttattcccggcatccgtcgtcacggcaacctctttccggtcaaaatcagcataatacatatccagcttacggatcatctgatgatctgtttcatacaattccccgtacacaaaagctgtttctgctaaagacgccgcaggctgacctttatccgtttcgtacagcacaccgtttatcgcggcctgctcgcacacacatagagcgcctttcagcagttcatggttttcttcacgcttccgtaacaaaccgtatacaaaaagaagcaagttatttttcctccttttggacagcagccgcttctaacggcagaatcacctgaaacgtactgccttctccatttttgctcttaatgttaagtttaccattatgctccttcagaattcgtaaacaaatcggaagcccgagacccgttccctgatcttttgtggagaaaaacggtttcccgatattttcaagcttttctttcgacatgccgtttccttcatcctgtatgctgatcaccgcgtattcttcatcccgttctgtataaatatgaatattcccgccgtcaggcatcgcttcaatcgcatttttaataatattgataaatacctgtttcagctggttttcgtcaccgttgaccatacaggactcagtctgcctgaaatccttctcaatcacagtgttcgacagcaccgcgttcgtgtcaagaagcgtcgccacctgccttaaaatatggttgagatgatgagcggtaaacgtcacggtctgcggcttggcgagcagaagcagctcccccagcacgagatcaatccttttaatctccgaaaaaataatatcgaaataatccgttctttccggatactgggctttcatcagctggagaaagccgctgactgacgttaaaggatttcttacttcatgggcgattcctgccgcaagctccccggcaatggccagcttttgagattgcatggcaaggcgttcgttcgtttccagaagctcgtcgaccgcttttttccgttcactgatatcagacatcgtccccaggctcccgacaaatttctgtctgcggtcataatacagcttataatggacttctccccaaaagatcgtgccgtctcttttaatatatttggccgtaaacattcctgacggggactgctgcttgatttgggagataatataatcaatgatatgtttttcttttataaaataatcattatacatcgtgcccatacattcgctgatggagtggcccgtaatcgtcgtccaggcctgattcaaatatgtaatattcccttgtgaatccgtctgaaaaacgatttcctgcagattgtccatgatccggtttttctcatctgaaagcgcctttgctttctgctcgctgtccttcagctccgccagcagctgctttttattgtccacataataagccagcagccagacgctgattaatgtgacggcggtaaaggtgatgtcaacgggccagttaatcggattccgttcaatcatataaaataaataatcccaaaacataataaaaatcattgccaagattaaggaaatgatacgcgcttgatattttcccatagtcccacctgccgctaacatttctacatatattgtaacattgttgactgcattattgactaaaaaatgataactattcccaattaattgagcaggttcgcttacttttcccgtgagtttttgcacaagttcataataaaaggacggaatgatgccccgccctttttgctgattatgatctatcttttaacgcttcttcgatttcctcaagcagcattttcgctccttcaggacttaaaataattttgccgttgccgtactcctgattttcggaggtaatttccccggtcatcaagcaaatgccgtgcggcttgtatttttttaagacaattttgtctccgtcaacgaaaaattcaatactatctttaatagcgatatccaatgctcttcgcaattcaatcggcatgacaatacgcccgagttcgtctacttttcttactacaccaattgatttcatagaaatcccctacttcctttaatgtctcttctttatgtccaaggaaaatccttcataaacgtagacgaaaggaacggagcaaaagtttctcagcatccggaaatgaatgttttttacaaaagaaagccttttgaaatacgggatacagactttccctccttttttacaaaaacatttcattcccggcggaaacccccaaaaatcgtggtttttctcagaaactttaaatgtagaatcaattaaatcaggatagggattgggtgaaaacatgtttcaatcaactgagatcggaatcgacttaggaaccgctaatatacttgtttacagtaaaaataaaggaattattttaaatgagccttccgttgtcgctgtagatacaacaacgaaagcggtgcttgccatcggaacggatgccaaaagcatgatcggaaagacgccggggaaaatcgtcgccgtacggccgatgaaagacggtgtcattgctgattatgatatgacaactgacttattaaaacacattatgaaaaaagccggaaaaaaaatcggaatgaccttccgcaaaccgaatgtcgtcgtctgcacgccttcaggctcaacggccgttgaacgccgcgccatcagtgacgctgtcaaaaactgcggagcgaaaaacgttcacttgattgaagaacccgtagccgctgcaatcggggccgacctccctgttgacgagccggtcgcaaacgtcgtcgtagatatcggcggcggtacgactgaagtcgccatcatctcattcgggggcgtcgtatcctgccactcgatcagaatcggcggcgaccagcttgatgaagatatcgcctcgttcgtcagaaaaaaatacaacctgctgatcggggaacgcacggcagaacaagtgaaaatggaaatcggatttgcattgatcgaacatgtgccggaaacgatggaaatccgcgggcgtgacctcgtaaccggtctgccgaagacaatcagactgcagtctaatgaaattcagcacgcgatgcgtgagtcgctcctgcatattcttgaagcgatcagagcgacgcttgaagattgtccgccggagctcagcggtgatatcgttgaccgcggcgtcgtgttaaccggcggaggctcccttttaaacgggatgaaagaatggctgacagatgaaatcgtcgttcccgttcatttggcggcaaatccgcttgaatcagtggctatcggcactggacgttcattagacgtcatcgacaagctgcaaaaagcgattaaataataagattgtgcttcttttttctccggccggctcatattgtgagaactggagaaacattaaggaggaagcatatgcttagagatgtgggaagacgcgtagcagtagccgtcattttaagcggaattattttgggggtatgagcatttcactggccaatatgccccattctccggccggcggcgccgtaaaactgaatcatccgtaaagacgcagcaaaagctgtgtctttttcgtttgtgctccttcctttcctttatgaggcgatatttgatatgatgagaaaaaccgatgaggaggaatgaacgatgagttcgtttactgaaaagttaaatacatatgctcagctggcggtagaagtcggcgtcaatgtccaaaaaggacagcatgtcgtaatcaatgcctcaactgatgtccgggaacttgtcagactgcttgccaaacattcttatgaaaaaggcgcaaaaaacgtcaccgtaaattggcaggacgatgaactgtccagattaaaatacgagatggcaccttttgaagcgtttgaagagtatcctgaatgggaagcaaaaggaaaagaagagctcgcgaaaaaaggggctgcgtttatttctgtcgtctcatccgaccccgacctgttaaaaggcgctgacggcaaacggattgcagcgttccaaaaagccgccggaaaagcattgcatacatacagacaatatattcaatcagataaggtcagctggacggtgatcggagcggcttcaacaggctgggcgaaaaaagtgttcccggatcagccggaagaaacagccgttcagcttttatgggaagaaattttcaaaacaacccgcgtaaatgaagaaaaccctgtggcagcatggaaaaaacacgatcaaaatcttcatgaaaaagtggaacacctgaacaaaaaacattacagcgccctgcattatcaggctgaaggaacagacttaaccattgaactgccgaaaaaacatgtatgggcaggcgcgggaagcgtgaatgaaagcgggcacgaattcatggccaacatgccgacagaagaggttttcacccttccgcagcgtgacggggtgaacggcacggtttccagcacgaaaccgcttagctacggcggcaacattattgataacttcactcttacctttgaaaacgggcgcattgtcgatgtgaaagctgaaaaaggcgaggagattttaaaaggcatcgtcgaaaccgatgaaggctcacactatctcggtgaagtggccttagtgccgtacgattcaccgatttcacaatcaaatattttattttacaacacactgtacgatgaaaacgcctctaaccacttggcgatcggcagtgcgtatgcctttaatattgagggcggcaaacaaatgacacgggaagagcttgtcaaagagggcttaaatgaaagcattacacacgtagattttatggtcggttccaaagaaatgaatatcgacggcattaccgcggacggcaaaagagaaccgatcttcagaaacggaaactgggcattttaataaaaaaaaggaggcgatcaggcctcctttttatttcgcttcatacatttgcaagttggcgaagacggtttccaaaacaggtgtatcaattgacaagcctttcgctttctcaagcaaaaagccgtgtaaatgatcaccttccgtcaccctgcccttttccatatctctcagcatcgacgatttcatatggtaagacatgcttgtcaatgtgcgataactctcttcttccagaccaggatctttcgggatgccggcagccttgaaaatggctccgatttcagcaaagaggcgctttgccgtgctgcggccgccttctgtttctaaaatcggtccgaccggctgttgaaacagagtggtcactcccgcctgcgcggcaataaacatatattttttccaaatgtccttttcaatatccccgctgatgatgacatccgctttcacgcctgcaaatgcgttttccagctcattcatacgttctgtgcgctccccgttccattcaccgaaaacaaaacggtgggcagcgctcgtatgaagaatttcccctttgtcgttaagggcgctctcaataaagcagaggccgcccagcacctgccgttttgaaaaagcttcaaacagctggttatagtgcctgtatccgtttaaaaaaggaataatgaccgacgaaggcttgacaaacggtttgacatcccgaatgacgtcctgcaaagaatacgcttttgaagcgatgataacggcgtcaaatgctccttcttcgcccgccaacattaatttcggcttgattgaaacatcaccttttgcacttttgacggtcaaacccgtttcttgtaattgttccgcccgtttcttgcggacgagaaatgtaacgtcatttcccttttctgcaagacgcgcgccgatatatccgcccactcccccagctccgacaactaaaaacttcatgatgcattcctccgtctcttttcaatttatgtattcctttattgtaatgggaagtcagaagattgaaaacttttttcataaataaaaaagcagagtctcccctgcttctttattacgcgtatagctcttcaagctttttctgcacatccgcgttttcaagaaattcgtcataagacatttgtttgtcaacaatgcctttaggcgttaattcaatgatgcgattggcaattgtctgtacaaactgatggtcatgagatgaaaacagcatagcgcctttaaagctgattaagccgttgttaagcgctgtaatggattccaaatctaagtggtttgtcggttcatccagaattaagatattcgcgccggaaagcatcgcttttgaaagcatgcagcgtactttttctcctccggaaaggacgtttgattttttgttgacttcttctcctgagaacagcatgcgtcctaagaaaccgcgcagaaagctttcgctttggtcatgcggcgagtattggcggagccagtcgacaaggttcgcatcgctgccgtcaaaatattcgctgttgtctttagggaagtacgcctgagaagtggtcacgccccatttaaatgtgccgctgtctgcttccatttccccggaaatgattttaaacaatgtcgtaacggcaagttcgttgcggcccgtaaatgcgattttgtcttctctgttcataataaagctgacgttatcaagcaccttaaccccgtcaatcgtttttgttaagccttcaacccgcagcacgtcatttccgatctcgcgttccggcgtgaaattgacataaggataacggcgtgatgacggtttgatatcatcaagcgtgattttatcaaggagtttctttcttgatgtcgcctgctttgatttagaggcgttggcgctgaatctggccacgaactcctgaagctgtttaatctgctcttcttttttcttgttggcttcctgagaaagctttaaagcaagctggcttgattcataccagaaatcatagttgccgacgtacacttgaattttattaaaatcaagatcggcgatgtgcgtgcacactttatttaaaaagtgacggtcatgggatacgacgataactgtgttctcaaagttgattaaaaactcttccagccactgaatcgctttcagatccaagtggttggtcggttcatcaagcagcagaacgtccggcttgccgaacagcgcctgtgccaaaagcactttcaccttttctgaaccgcctaagtcggccattttcttcgtatgcaggtcttcagagatgcccagcccctttaacaaaatagcggcttcactttcagcttcccatccgtttaattccgcaaactctccttcaagctcagcggcgcggatgccgtcttcatctgaaaaatcaggcttcatataaatcgcgtctttttcctgcatgacttcgtataaacgtttatgtcccataatgacgactttcagcacttcgcagtcttcatattcaaagtggttctgcttcagaatggcaagacgttcgcccggactcatatggacatcgccggtctgaggctccagctcaccggataaaattttcaaaaatgttgattttccggcaccgtttgcgcctattaatccgtagcagttgcccggcgtaaatttaatattgacatcttcaaataacttgcgatccgcaaaacgcaagctcacattatttacagcaatcatttagaatcctccatcgtgtctatcatcattaaaagtataccatgaataaaggggaagagaaatgtttccctgcgaatatacgggtttgaaaagatgcaggcgtcaaacccggagcgctgtgatacaatagatatatatacatattcatcacggaggaacaagttgaagcttttaacactcacagaatactgtcttatgattttcttcaccggggtttttctggccgtcacaggctttacggcacgtgacatcggcttgtacgtcggaatcgccctcatttatacgttttcgcatctcttttccaaacggatgcttgaaagacgcggcaaagagaagaagcaggtgaatcttttttcagcgttctggccattgtcggatcagtgctggccacggtattgttcatcgccgtcgcggcctcgtttgccaaataaaaacgcctgctgtccgaatcgggcagcgcggcgtttttattttgtctgacgcatatcatgaaacgggaagaacacaaacttcgaggtgccgacgatccggttttcggcaattaagccgaggccgttccggctgtccattgagttcagccgattgtcgcccatgacaaagtatttgcctttcggaacctttacggggccgaaatctcccgtcaggttgactcccagttttttcgcttcttttttattgctcgcgaggtacggttctgcgatttttttgccgtttatgtaaagcgtgtcatttttcatttccaccgtttctcccggttttccgatgagccgctttacataatggactttcgatgtatcgccgttaataatgacgatgtccccccgctcgatttctccgatataattgacgcttttgttgacaaacagtctttcaccgtcatgtaatgtcgggtacattgatgatccttccactaagtacggttcaaacaggaaatggcggattaacagcgcaagtgcaaccgctataatgatggcctttccccattcccaatacgtgttggattttctttttaccgatttttcagaagtaggtttttgttcttcagtcaacgtggttcctcctagacgatcactgtttcggttcatgtaccatctttactttatcacaactcatcacaaaatacataacgcttctatgcgtatatgattgaaaaaagcgcccgtaaaggacgcttttcgcttatttctctactaccggttttttgatgattcccaagataaccgccgttacaatcgctccgatcacgatgctcattaagtaaagcagcggatggttcgtaatgaatgcaacgaatatccctccgtgcggtgcaggaagcgttacccggaaaaactctgtcagtccgcccgctaccgcagaaccgacaacggctgcagggatgacgcgaagcggatcagccgctgcaaacgggatggcgccttctgtaacgaaagctgctcccatgaagtagcacgtaataccggcttcacggtcacgtttagagaatttgtgtttaaagaatgttgtcgccagtgcgattccaagcggcggagccattccgcccgccatgatggccgcatgcggcgcatagtttccggcatcgatcatcgcgataccgaaagtgaacgccgctttattgagcgggccgcccatgtcgatagccatcataccgcctaaaataatacccattaagacaaggtttccagttccaaggctttcaagccaatttgttaagaaattcataaacgctgctacaggtgtgttaatgacaaactgcatcaggacaccggtgataaaaataccgagcagcggataaatcaatacaggttttaatccgtcaagagtctgaggaataaagacaaacagctttttcaaaaggactacgacataaccggctaagaatcccgcaatcagtccgcccaagaatccggcattcgcctgcgtagccataaatccgccgaccatacccggcgcaaatcccggacggtccgcaatactcattgcgatgaatccggcaagtactgcaacaatcagctttaacgcattaccgtcaccgataaagttcagcgctgcagcaaacgtgttgtatgtcgggtctttcggatcagctgaatgaattccccagaagaatgaaatcgcaacgagaattccgccgccgacgacaaatggcagcatgttgctgacaccgctcattaagtgtttatagaaagtacttccgatgcttgtgcctgatttctgtttcggaccgtcttcatttgaagcggaagatcctccgccgctgccctcgtaaatcggcgcatcttggttaacggctttttcaatcagttcctgtggacgtctgataccggccgtcacaggcacttgaagaacatgtttgcctttaaagcgctccatttcaacctgtttatcagccgccacgataatcgcaggcgcgtcttcaatttcttgagccgtcagcttatgtttaataccgcttgagccgtttgtctcgactttaatgtcaacgccgagctctttcgctttttctttcagtgcgtcagctgccatgaacgtatgagcgatacctgtcgggcatgccgtaaccgcaaggattttcccttttcctgacggcgctgcctgttcttcctgctcttcttcttcctcatcgtcatctttgtcatgctgattgatgatgtcaatgatcgcatcttctgattcagcttcaagaagctgtttgcggatttcctcacgcataagaagcgttgaaagtcttgataatgcctcaaggtgcgtattgttcgctccttcggttgccgcaatcataaagaccaagtgtgccggctgaccgtctaatgattcataatccacaccatcttttgaacggccgaatgcaatggccgggttaatgacgctcgccgtcttcgcgtgaggaatggcaataccttcgccgattcccgtcgagctttggctttcacgatttaaaatggctgctttgtaagcctctctgtcatttaatctgccggctttgtcaagcactgtcaccatttcatcgataacgttttctttctctttgctttctatattgagatgaattgtatctcttgttaacagctcagttatcttcacttttctttcctcctctatagacgtgtgactttaacttcaggaagaagctgctgtacaaactcttcagttccgagttcttcagaaaatgccgtcgcgcttccggaagcaactcctaaacggaacgcatcttccaaaggcagctgttttgaaattcccgcaaggaatcccgcgacgacggaatcacctgcgcctaccgaattgacaagctttcctttaggaacattggcgaggaaaaccgcctctttcgtaaataaaagcgcaccgtcgccagccatcgaaacaatcgcgtgttcagcgccttgttcaattaattttttaccgtaaggaacggcagcttcggctgaatcaatgaccgtattgaacatttccccaagctcatgatgattcggcttcatcaaaaacggtttcatttctgtcgctttcatcagcgcttcaccggagatgtccaccactacccgggcattctgctttctgcatgcctcagcaattttttcatacgtgttatgcggcagggaagaagggatgcttcccgctaaaacgacgatgtctccctcttccagagcggagaactgttctaaaaaggcattgaacacttcgtctgaaatcgtcgggccctgtccgttaatttccgtttcatcgcccgttttcagttttacatttatacgcgtgtcttcatccacctcagaaaaagccgtttccagaccttcctgctgcaaaaatgacgtgatataatttccggtaaatccgccgacaaaccccaatgcttttgacggcacatggtgtcttttcagtaatctcgaaacgttgatgccttttccgccgggatacttcgtgtcatagctggaacggtttaaaccgcctacggcaaaatcttcaacgtgaacgatatagtcaacagacggattgagagttacagtgtaaatcatggtttcactacctttacgacagttttttcttggtaatcatcgaatgcaagttcttcagcttcagtggtaatgatagctgcatcgcccaaggcggcgaacgctgcgaaagaaatctcgccgaatttagaaggatcggctaaaacatacgcatttttcgcctgtctcacagcctttgtcttcagaagagcctcatccggatcgggtgttgtaaagccggcttcaatgtgcacgccgttcaccccgagaaagcttttgtcaaaacggtactggctgaccgccgttaatgaggcgccgccgatcatcgcacctgttctatgcttcacatatcctccgagaagataaaaaggaatccccttccttattaaagcatcgatatgcataaccccgtttgtgacaaccacaatgtcctttgtatgatctataaaatcaatcatgtgcaatgtagttgttcccgcatcaaggtaaatacagtcaccttcttctaataaagatgccgcttcttcagcgatcttcagtttatcctgaaggtttttggaggatttttcaagcatatcgggttcttgcctgctgttggaaagtttagacgccccgccgtgaacgcgctttaaaaatccgcgctcttcaagtgttgataaatctcttctgatcgttgattcagaagcgtttgtcatgcttatcagctcttgaatcttcaccacatctcgcttttcaatctgatccataatcagctgatacctttcaggagtgagcatattccgcctcctttgaaaacgtattcatttcggctgcaagataattgtaaacgctttttttacttcaagcaactaaaatcactcaaattcattcaataactatcaaaatctttcacatttgttcatattaacgtatgtacatagggtttgtaaactgtaaattcgacaaaaagggggacaattgtatgacattttctttttatcataaatgaaaaaagtctattatattcattcaatcattaaaacacaaaaaaccccatgcagactgcatggggcgccggttattcataccgtaacgcttcaatcggatctaagcgtgatgctttgttggcgggcagcatgccgaagatgacgccaatcagcatactgaacagcacgccgatacaaaccacctgccaggaaacgagcgacggccagcctgcgataagggaaacgagtgttgctcccccgtagccgagaccgattccgattaagccgccgattaaagtaagcacaacagattcaattaagaattgtgtcagaatctgtcctctcgtggcaccgagcgatttgcggatgccgatttctcttgtccgttccgtcactgatacgagcataatattcatgaccccgatcccgccgacaacgagagaaataccggcgatcgaaccgatgatcgtcgtcataacggtcgtgacctgaccgattcccgccgcgatttcttccatattcatgacttgataggcctcttttgtaccgtgattgtcatttaagagacgggccgcttcttttcctgttgttttgatttgatcagcggactccgtctgaacggaaacgttgctgtagtcgttagtaccgaaagacgttttcagcatgttgaacggcacatacatttcactgagtcctaacgataaaaagccgctctcttctttcagtacgccgattacttctacgggctgtccgccggcccagacgattttcccgagcggagacgttttcccgaacagcttttcagccatttttttcgagatgattcccgctcttttcccggaaagaaaatcattgtccgtaaacgtccgtccatcttgaacgtccagcttttttacgtccaagtagccgctgttaatgccgttcagcgtaatatccgtgtcttcttcatggtaacgggccgtcatggattttaccgcggaagcgacaacctgctttacgccgtccactccttttaatccattaatatcttcttctgtaaaactcgcttgctgtaaggcgttcggattggctgttaattcttcatcactgggcatgtaaaacaattcaatcgtattgcccggcccgctgatggattgcttcagcatttgctctccgccctggccgacagccacaacaacgattactgaaccgacgccgataatgattccgagcattgtcagaatcgatctcagcttgtgagctcttacggaactgagggccatccggagattttctgacaggctcattcccccactctcctctgctcagaatcgcgggaaacgatcatgccgtcacggacgaaaatcactctgtttgtacagtccgccacttcaggctcatgagtgacaagaaccacggtcacgccctctgcattaagctctgtgaactgctccataatggaaatgcttgttttcgtatccagcgcgccggtcggttcatcagctaaaatgagcttcggttcgttcacgatggctcttgcaatcgcgacacgctgcttctggccgccggacagctcattcggcatgtgacgcatccgatccgccaaaccgactttttccagcgcgtgctcagcccgttcctcacgctcttttttgccgataccggcgtagatcatgggaagttcgacattttttcttgcattcaatcgcggcagcagctgaaactgctgaaagacaaaaccgattgatttgttccggaccgccgcaagctctttttcggtgcatgaagaaacatcttcgcccgcaagactgtaattgccggacgtcggtctgtccagacagccgatgatattcatgatcgtagattttcccgatcccgagggtcccataattgacacatattctccttcttcaatcgtcaggtcgattgaacggagaacatcaaacgtctccttgccgatctgatagctttttttcacctttgaaagctgaatcatctatgctttcacatccgttccgtcagtcaaaccgtcagccggattcagaatgactttatcatcctttgaaagcccctcttttatctccgtaagctgatttgcggtatcgccgactttaactttcacgcgtttggccttcccgtcttttaccgtaaagacccagtgctcatctccgtcttttttgactgcggaggacggcagcgtgtcggctttccgtttgtcggtttcaatgttcataattaatttaaatcccggcttgccttccggaaggtttccgatcagcttaacctgaaacggatactggacggcttgttccgtgctttcccccgaagcagcgcttgacttttgatccggaacgaggccgacagccgccactctccctttccacgttttaccggggatggcgtctgaggtgattgtaacgctttggccctttttcactttcagcgtgtcgtattcggacaaattgccggcaacgaccaggtgttccgggtctcctatatgtataaccggttcttgaatatccgattttttagaagccgcttcttgatttaccgagataaccgtcccgtccatctcactcttaacattgagattcgacacttgattttcaagagactgcttttgcaaatcagattgctttaattcgatttccgccgttttttgctgaagctgcagatcagtccgttcggattcaatttgttttttggcttccgcttctcccacttgttttgccagatcttgttccttgctgtttaatgctctgagtttttcttcaacttgttcgatttgcatccgttttgattgttctgtcaactcattttgttctttatcaaggttgagctgctcatttgtatacgtgactaacgacgaccctttttttactttgtcgccttcttttactttcactttatcaagagttcctttatctgcttcataaaaaacatactgttctttagaaaatttaagtgttcccggaaccataaccgtagatgagatttctctgttttccatggttccggtttcgattttttttccggcgctgccgcccgcgggagcggcagacttataaatattgataccgataaatactgcaacaattacggcgatgccgattccgatccaaatttttttcatgttatacacctgctgtcactgaacttaacagtcctccgactgccgaaaccaaaagcataataacaaacaggacaatcgcggaagtccaggccgcttttttcgaaatgccgcctgtatagcgaagtcccaaagccagcagaatatagctccagatgctgaaaatgtcgaacgcgcttaaaaagaccgcgacgccgtctccggccggtatgacactcgccaaagatgtaacggcgtacaatgagcccgcaccggtaaaataagtgacaagaccgttaataactaagccgatattggtaataaacgccgtaaacaggctgagtgagagcatttttttgtaagttgtcacgccgcctgacattttgacgcacagccagtaaatgagcggaacgataaacagagcgataatgcccccgaagattcctccgaacatcgtgccgaatttagcgaaggttttggtcatttcaatctgatcatccgtcaaaccgtcaagagatgagctgttcagcacttcttcataattcatccccagtccgcgcaaaatactgccggccgcgatgagaatgatgacaatcaggagaggtatgccgatgaccggcttttcttttaatcttttaaactgcacaacaggacttgtaatgacgccgaaaattgacggcttttccgtgactgccgcattgcttttttccaggtttggttccatatagctgatgcctcctatgtattattctgtttatacgtacgctttaggctgagagaagtttcaatttttttgccgtttgcgtatttatgctaaattgtaacacaaattctcagctttacgttccataattatgtaaaaaaaagcatcgtcagaccggtatgacgggtaactcaaaaccttgtaaaggcactgttatcagcctattcatgcagtgaaaaccgcctcaattgcaaaaccctttaaatcccatttagatattctctgaaattcagcgcctataaacaaaaaagccggatggcaatgatgcacatccggctcttttttcaccctccgcttacaggagggataaaggcaatggtatcaccttctgttacggtgctgttgtcttttacatatgtttcattgattgcgatcatggcattgtcaatcgtctgaaggccgtaccgttcctttaacagcgtttttacagcagacgctgccgtctctttttcgtcaagttcaatgaccggtgttcccgcctgctccgcaagcccggcaaataataatactttaatcatcgcgattcccctttatccaaatccggttttccgttcggatagggcgttgtttccagctgatcgcctatccattcttccccgtcttcccagatttcttttttccatatcggcacaatctgttttatccgttcaattgcatattcattcgcctcatatgccgcctttctgtgcggagaagacacagcgattacgaccgctgcttcaccgatatcaaggacgccgacacggtgagtgattgcagcttcggctccttcccatttcgcgctgatttcactgccgatttgagaaagcatttgaacagccatcggttcatacgcttcatattcgagacgcaccgtccgccgtcctgcagtccactctctgaccgtgccgataaacgttgtgatggccccggcttcacgcttttcaactttttttacgatattttccgcaatgataggttcccttgtaatttgaaaacgttccatttaagcagtttcccctttcagctgcgaaagcacaaacataatggcagcaggatcgtccgcatggaatacgggcttgcccgcatctgccggcatatgctccgtatttctgctgacaaccgcgatcacgcgctccaaatgcttcagcttttgccaatcttcgctgtttttgatcataatgattttcggatgcggcgcatgtttaaatccctctatgagaagaccgtcaattcccagacattcatacagactgatcaaacccgccagatcccatttttttcgcgccgtaagctgcaggacgccgtccccttctactgccgtaaccgcggctccggcttttgaaaaacgctccgagtcttttccgtcagaaaaaggttccggttctccgccatgtccgtgatgttttaaacatccaatatcgcactctttcggcgcagctttcagcacacgttcaataaacgttgttttaccgctgttttgaaaacctacgatctggacgatcgggaaagaattgaccacggccattcacttccattctcatcacggatgaggagcgcgtgaaccgtccggcccgcttcataccccctcgttcctcccggcagaaggataaacgcgtttgcttcggcaagagatgtgactgagcttgatttgtcgagaccgaccggtgacgccatcatttttccgtccttatgataaacaaatgccctcacaaatctcgtaaacggattcggcttcggaaagtcgtttgttaacacggcttccgcccatccggaatgaggtttttcattcagaagccatgtctgaatcatcggtttgacaaacagggtgaatccgacataacatgcggacggattgcctgaaaggccgaacagcagcatgtcatcggcccgggcgacagttgtcacgctccccgggcgcattgccactttgttaaaaagaacttccgctccgagcttattataaatgtccggaagaaaatcaaaatcgccgactgacacgccgccggtcgtgatcagaaaatcaacttttttcatagcttccttcaccgcagcatagctgtcatcaaaatcatcggaaattttccctaagttcagcggtactgcacccgcttcaatgacctgggcatacaccatggcagcgttgctgttgcggattttccccggctcaagcggatcgctgacatgaagaagctcggttcccgttgcgataatgccgacaaccggctttctgaccacgggaacggaagcatagccgaaggttgctaaaagagcggttacgcccggcgtgattttcgtccctttttttaatagcgagctgccttttttcgcatcttctccttgatatgaaatattatcgcccgcatgaaaagggcgtttcactgacatgtaattcgtgccgttttcagaaaacgtttttgtcagctcaagcatcactacagcatccgcgcctttgggaatctgcgcccccgtcataatgcggaccgcttcataaggcccgagttctttttctgacacggcgccggctccgatatggtcaatgacttcaaaggtgacggcattgtcacgggaagccgtttttgaatcgctcgccctgatggcaaacccgtcatacggagaacggttaaaagccggcacatcatgatccgccttaacatcctccgccaaatagcggtggagactgtcctcaagcgccacccattcggtatcccccttttttttataccggctcacccggcggactgcttcgtccacctgaatcggcgttcttttttcaagcatagcaatacatccccttcctacagtccgatcactctggccagaactgaattcgcttcttttatatcgtttgtaccgtgaatcagagcccgtccgtcctgaaaaataacgattctgaagcgctcgtacgccatgtgcagcaaaaattcatttgcttccactttaccgatctgcttcagacgtttgacaagctcttctttatccagcctctttaaggcttccgatctgatttgaacggtgtctcttccgcacagcacgcttgctttcggcctgttttcaggctgcagatacggatatacgggctccgcgccgcaggaagggcaatgatcccgtttgatctgatccacatttatgctcatattggtgttattccacacgtcaaacgtgaaaaagcgccgatttaccgccgcatgatttcctgtcagcaatttcagcgcctcagcctgctgataggcggagacgatatgaaccgccggaggtatgatgcctgctgtatcacatgtcgctccgcccacgggcatttgctcaaacaggcaggataaacacggcgtaacccccggaataatcgtcatgcacattccctgactgctgacacaggcaccgtaaatccaaggtgttttcgttttcagcgccagatcattgatgaccattctcgtttcaaaattatctgtcgcatccacaatgcaatccgcttgttcgatcagcggttcgagcgtttccgccgtaccttccgccgcgtaagcatcgatatgtatattactgtttaccgctaaaagacgcgccttggccgccattgctttcggcaggcgctgtctcgcgtcttcttctgtatacagctgctgtctttgtaaattgctccattccacataatcccggtcaataatcgccatacggcccgctccggctcttgcaaggccctctgccgcggctgttccgagggctccggctccgacaatcaggacactgctgtcagccagcgcctgctgccctttttcccctatcggcttaaatcttgtctgccgtgaatagcgctcttccatctgtgttgtccccttgcatttttatttccatcataccatgtttcttaccgatcagtcctgatttgaagactcgacatgcgccaaaagtctggtgtaatcgtcccgtgtgttgatattagcgaactcctccggcccggcgccgatgtcttcagcctgcacataacagacagacagccgtttcagcgtgtctgtcattttcagtttgttttgtgtcagctgatcaaaaagcacatcctgcacccgtttatggtaaaccgccaagaggggctgctctctgttttcacaaaccggtatgacagcgtccagatttcccgtcagcttcatttcaagcgcagccatcgtttttcttgtcacgagcggcgtgtcacaggatatgaccgtatatgtttcgccttccgtttgtttcattgccgtatatatgccggcaagcgggcccattccccgaaaccgcggctcatcggcaaaaacatgccgctccctgtttgataagaacttttttatatgctcagggcggctgataattaccgtttctccgccgccgaaggcttttttcgcctgttcataaaacatgccgcccttccactttgcaaaagctttcggttctccgaatcttcgggaagctccccccgctaatattacattcacccgtttcatgtcatcgctctcccattctatataaaagcatagcaaacgcctcagccgaaatacaatattacggtgcttgtctgtttaattaagaggaatagccgttgttcctttcccatattgtagtgttaacatcaagagggagatggttcttatgaaaatatcaggtccgtttttccacgacacttctcaagagaacctttacttgaaatccgaactttccagatgcagaaaaataatttcggaatttgaagcaagctacttccatcaaaaaaacaataagcttcaggaggaaaacgccaatattaaagagcggcttcacaagctttctgacgaattggaagccatggcgcaaaaacacaaacagactagtgacacggaacgttctttgcatgaaatcagggccgggctgctcgataaaatcgtcattctgcaagaactgcttcagcaggaaacgtttcggcggaaaaatgagatggaagaaaaacatcggctgcatcttacaaatgtaaaatttgaagaagaaaataaaaacttacatacccgcatccgctcacttgagaccgccgttcaaaccgaacggacttctcacgaagatatgaaacagcgttatcatgccgctgcagacgaaaatacccggctccaaacacaaatgatagaaaaagaataccagctcaaacatattaaaatagaaattaatcatatgagagatcgaatactagaaacaaaagaacggcttgtagaaatagaaaaaacgaaagaaaagttatttcaagaaaccattctttcatataaacggcagcttgacgaaagcgatgcttggattgccggccattttgctgatattgacagccgcacggcggaaccggcggaacaaactctggaaatcccttccgtttccaaagagactgttcaggcagaagacttgcttacagccgttaccgaacaagtcatctcccttcaaaaacaatttgtagaatcagagtcccgcgatcagtcgtttgatgaaaaactggatgcgttgaaagaacgagctgacggcgaaaagcctttccaaaaatatgttgtcaagcttgaaaaaaagcctggaaaagatgcgtcacttccgcagaataaacgggaaaacgcaaaaaaactgcttgagtaacgcaagcagtttttactgttttattcagcagccgtatcatttgccgtttctgctgtttcctgagaaatttctccctcaagaatatattggccgcgatatggttttttcacttccggatacattttaattaagctttgcataaatgttgtcatattaggaatttcaaggccgctttccttttcaatttccttttgcagttcggaacttttgatcgctgcattgtggcgtttcaatgttttaatcgctgcttcgcgcagttttgccgcttttgatcccggtctcgccgtccctcttcttcttcttgtagaaccgtctggaatgccggcgggaagagacgtaatagactgcatctgcggctgggaggattgcggctgtgtctgcggcttttgatagcttctcatttcctgtgctgcaagctctgcaagcaccgggagagagtcactttttttctccggacgaaactctttttttgtatcggacaggctgcccgtattgtctaattctctcagttttgcatatattttatcacgttctatttgatattcacgaatgacttttacctctgcttcgttcaattgttctaaacgtaagcgcagcgcttctctttcattaaacatgtgtaaaaccccctgtcaaaaatttaaacgcttttattaagatattagattacaaaagtaattttatcaactattattttatcattttactattttatttactctatgaaaaattgcttattttctgaaaatggtactttatatacaaaaatcccttatcatataggggattctggacaaagttccaatttattgaaccatttcaaaatataacttgaaattacttgtttaatgaaaattagcgtgatatctacaattttcgactataatatgtaaaagttaatgatatggataaaacaagcggtacagcgtgtttacggctgtttctcttattttttaagccatacatgccatattggaattttttatccaatagccacaaaaaaaccctgttacctaacggcaaagggtttgcagaaccgagacaatagtccggcggagattgtcccgattactcagaagcctgctccgtttctgaaagtacccggctgatgcgtttttcaagcattttcatcccgctctctcccgcttgaaaatggcggagctgtccgcttttatcaaaaacgtaataagccggcacatattcattttcaaatgcgtcagccagcgtatgatcgctgtcaacgtaaatcggctgagagatatcgtgttcagccgctgttttcttgattttctcaagatcaagatcgtcttcggaacggggcatgtggacggccaccacattcagctgatctttatatttatcacgaaacccgttcacctcaggcatcgcttctttacacatgcggcagctggcggaccagaagtgaatcagtgccggctttccgccgaccagctgttccttcgtaacttctctgttaatccatgctttagcgcctgttaattcaggcatttgctgatgtaatttcatcttatttccctccttatgaaaaaagttttttgccggggctttcagtccgcctggcaacgttctcctgttttccctccaaaggaaatgatttggctgaatcaccatgttaaaatgagtgtggcgattccttagttcatatcttcacaaaaatgaagatattgaaaccgggcaatatgaacaaatcataaatgtaataactggtttctatgaaaaggtttatcttatttaaaaaacgggtatatcacttttagctttttcctcaatagacttgaaaggaagacatcactatgattgatttaaaacactttgattgggccgggcttctcacatctgccgggattttcatcataaagctggctctcattattttagcgtattttattttccggacggcaggaaaaaagctgatcaagcatctgtttcagaaattcgagcaacaaaacaacctctccacaggccgcgcttatactttgcgaagcctcgcgcttaatgtgtatggatacatcctgattttcgtttttatcgtaatgattttggatttatttcactacaatccgagcgctctcattgccggcgccggcgtggtcggtctcgccgtcggcttcggggctcaggggcttgtcagtgacatcgtcaccggattttttatccttttggaaaaacagatcgacgtcggtgattatattacggttgccggctacagcggcattgtcgagcaggtcggtctccgtacgacgcaaatccgtagctttgacggcacgcttcactatctccccaaccggggcattacgaatgtgagcaaccattcccgcggaacgatgcaggcgcttgtcgatattaaagtgccgcttgaaaaaaatcttgatgaaaccattcaaatcctgcaaaccgcgtgtgacaaagcagccgctgagctcccgcagattaaggaagggccggacgtcatcggggttcaggatttaagcacgtcagaaatggtgatcagaatcattgccaaaacagaaaatatggagcaatggcgggttgaacgcgtactgcggagagaaatgaaaatcgcgctcgaccgttttaaaaacgccgcttccgccgaatagaaaaaccgaagcgtaagcttcggttttttctttttaatgaaattttttttccacttcgctgcagatttcgtcggcggtcattccggaagccgtaatgacgggagcctgagttgacgtatcggcaatgccttggacattgctgtcaagtccggttacgacacagcagtcacaattcttcgcatcctcaggagtcttcatcatcactacgtcatatcctttttgttttaacgcctgttctacatccgataaagattgttcaattccaatttttttcgtcatattgaacacctccgttatgtagaatgctcaatttttgttagattattcttcttttcggatttaattggcatacttcgaaaaatatccgaccatgacatttaccgcggtttccatcgcatcttcatccgggttcagcttggcgtgatgaagcccgtgggatgaatcggcccccagccagaacataaagccgggatattttttcagcatatatccgaaatcttctccggtcatcgcttctttcgccgttttcacgtcagcaagctgatgatcgctgacaaattgcataaattcttcggtcaggccgcttgtattataaacttgatgataaacggacggatacgtgacttttcctttgcatcggaagccgatttcaattcctttgacaagctcttcaatccgctttttcaccatacgcattgattcctcggaaagcgtccggatggttccctccagatgagcatgctctgcgatgatattttgcgccgtgcccccggtaatcgttccgacagttatcacagcgctgtcaagcggatccgtatttctggatatgaccgtttgcagctgcgtgacaagcgtgctcgcggcaacgaccatgtcatctgctgtatgcggatatgccgcatgtccgcctttcccctcaagatcgatgacgagctcgctcgtattggcaaacagcaatccgcttttggtggaaatggtgccgaccggcagctctggtgctatatgtagggcggtgattaaatccggcgtccattttttcagcacatcgctttcaagcatcggtgccgctccgcccggtccttcttcagccggctggaataaaaagagcagatcatgtttgacggggtgatggacaaaatgatcaataatgccgagcgcgatggtcatgtgcatatcgtgtccgcatgcgtgcataaaaccggggtgctcagatgcaaacggaagccccgtctgctcttcaatcgacagagcgtctatatccgctctgtaggcgagcattttttccggagccgtgcccttgattttgacaaagatgccggttctccaagtttcgatttcaattctttcttccggatattggtttaaaagattcagcaggtactgctgggttttatattcctgaaagccgatctccggaatgcggtgcagatctcttcggatggcaatgagccgctctttttccatatgtattcctccttgagataagaataaggcgtggattttatcatccacgcccattctatcaaaccattccttacagctggcgtaattcctgtttgatttctgttttgccttttgttttttcatcgatatctttgatttttttcgctggtgttcccgctacaacggtatatggctcgacgtcatttacaacaatggctccggcggcgacaaccgcgcctttaccgattgttacgccttcaagcacaaccgcatttgcgccgatcacaacgtcgtcttctacgacaacaggcttagcgctaggcggctcaataacgcccgctaatacagaacccgctccgatgtggcagtttttgccgacagtggcgcgtcctccgagaacaacgttcatatcaatcatcgtaccttcgccgatgactgaaccgatattaatagatgcacccatcatgataacggcattgtcgccgatctcgacttggtcgcggataatagcgcctggctcgattctcgctttcacatcttttaaatcaagcatcgggatcgcagagttgcggcggtcattctcaatgacgtaatcctcaattttgtctttgttttcttcgattgcgcttttaatttcagcccactcgccaaaaacgacgccggattggccattcaggaatgttttagcggaatcgccaaagctgattccttcgagatcgccttttacatacacttttacaggcgttgattttgtactattttgaataaatgaaataatttcatttgcatccatcattttcatatgtattgtcctcctctgattttctacctcattactgtaacaaaggaaggatacaaagacaagaaaaaaaggaacaagcctttattctgccggctggctgcacagcgcggcaaactgtcttccgaattcccggagctcttcttcctcactgccctcagggttgttttcaattttgaccggcggcagcaccacccgtccgccgcgggccgtgattactttttccaattcgtcaaccgctccgcaaaaaaactcataggacgtatctccggaaccgaacaaagcaaatgtttttcccgtaaactccagtttttccatatcttcagcaatatcgagcatttcatcaggaagatccccgtctccccacgtatatgtgcctaataaaatatactcgtaatcattaaaaagtccggcatgaatatccatcgcttcatatctgtctacggatgcttgtgcttcgatcagccctttttcaattaaatccgccatcgcctcggtgtttcctgacattgtagcgtaaacaagcaatacattccccatcttcgtctctcctttatgcataaaaactaatgtgcgagccgaaccgcctcatacggtctgacaaacttactttcgtaaaggcccgcgcaaaaaaaatcttcttcccggttggccacccgccatccgtgaccgcggatcgtatcaaaccactttaattcaccggcagcgagatcagcttgataaatacgcgaaaatccgctttcgtcctgtgacgaagtgacataaataatcccgttatcctcagacacgtcaagaaatgatttttcccgtacattgtccccggctgtaatggcaaactcctcatgcgtccgcacgtttcggacagcaagctccccccgttctccctttgccgcgccctttgctgcaatgagccagtcattctgatacatcatcattgaagccgtcatgcgctgcctttcgcggcttatacgccggatgcggccttccgtcgtcagatcatacgcccaaatgccgccatgattcatatgaatccgggtgccgatataaaccgtctgaccgtgtaaacaaagcgaacggatgacaggcggctcctttaattgtgaaaaaggcttagccacatgccaagtgacgccgaaatcatcagataagtagatgcagtatgtgccgtgcgcacagacaaatccgtcattccgcccggcaacggcccatacggaggcgctggtcggaaatcgggaggccgtccaagtctttccttgatcggccgatctgaggacggcgcctttttctccagccgcgaatatgtagggccctatataagtcagcacatgaatcctgctcttcactcggaatagtcttttccagccttcttccgccgaaaaatgaaaaataccttcgcctttcacagcgacaaaaaatcctgaagatactgatgccatgacagccgtcgcgcctttatgaaacatggcaccggtctccgtggtgagcggcccatgcaagaaaaccgcggacaaattctttgcagcattcttgatcttcagccgtctcgggcgccagctcaattttcagcgtttccggatataaattggctccggcctgttcaaacgcatcgcaaaacagcgtgaccgcttcgcaaaacttcgggtaggcgtgatcgcctgaaccgaaacaggccgttttcagtccgttgagctggctgtgcagaatatcttcgtaaaaatcttccgcttcgtaaggaagatcaccatccccccatgtgtatgtgccgacaaaaacataatcatatgctttgagagaatccgcatctgcttcgtccatatcaagacagtcaaccgctatctgatgcccgctcagtgtttcttttataatgccggcaatatcctctgtattccccgacatgcttgcgtatatcattaatgctttctgcatatgatcacctcgtaattgataatgattttcattaacatacataacactttaaatgataatgattttcattgtcaataaaaaataaaaaaaagacagcatgattgctgtctttctaaaatgggcgttcctgtttcagcatatctttaatgacagaaacaaaagcctgcacctgttttaattcaaatgccggctcataaccgagcagccatgtgtcacggccgatcggatggtcctttgtatcaagcaggggcattttatttactttatcttcctcttctaaggtgactgacggcagaatggcataaccgatcccgtgcagcgccatttgcttgcacgtttcaatctgatcgacaaggatggtctgtttcggcgaggttttgaatttttgatgccaccaatgctgaatttcctgaaaatatgtactgtcacttttgaattgaataaacggccggtcggtatgggcaatatcatcaatacaggaaatttccgtatcgaccaaatataaatgatcggtcattaaataatctttccggcctttccattccggatttccccggataatgccgatatgtacctgatcttcatacagacttttcagcatttcgctgctccagcctgtaatgagagagacctttgcattcggatatcgttccacatatgtttttaacactttcggaagccagtgctgcccgataatggaggcgacggcaagctttaatgtgccgtgaatctcaccctcaagttcatcaatgttttctctgattctttcttgccgatccgtgacgtcatttgcaaattgtatgattttttctcctgccggcgttaccgtaagtcctttttgagacctaagaaagatctttgttccccaggttttttcaatggtctgcaatcgctgggacagagccggctgtgacacgaataaccgttcggcagccttcctcatgtttaattcctcagctaaaactacgagcatatgaagctcttgaagctgcatgtcgtcctccttttcaatgccttttcgtattccttatctaccattctaatcaaataaaggctgccgaggcaagcgccactcgtatgtatgcgttttctttttctggcatgcgaaagaacaaataggctgatcgtgcgagcctacttattcaatgatctgatatgactgctcaactgctttaatacgactcttctcgtgaaaatgccttcaaagacgccttcatcattttcaacgcagacaaagccgttgttaatgaccatgctgaaccctttgataatcggatcattgatgtggagacggggaatgtctttcagcatgacttcctcaaccgtaatttgatccagcttctcaaactcgatccgttcaagtccgaaaatgctgttcataatcatatttgtcccgatcaaaccgtgcagacggtacgaagcgtcaaggacgggaatggcggtatagccggttttcgtcagcactaatagagcatgctcaaggttgtttccgacttgaacgtgcgccactttatccgcctcgatcataaattgtccgactgttgcatcaagaagctgatctgattgtaagctaatcatgtcacttcgacccctttacatttttcatcaaagcatgtattccctatattgcaataatataaacattatcattttttgtcgaaaagtttccgtcaataaaaaagatactctttgcaatcgagtatcaatttataggccgctgattaattttcgttccgaaaacggtcatagagcgttacgagttttttataagtggtcccatcaacgctttttgaccctgcttctatatcgttgatttcgctggtcaaaagctcaatggcatattcttgattgatcaggatattcagcagaagtttctgttcttcttccgtaaatcgttcactgataagactcatacgtaatcaggccccctatttttaactgaatacctctgaaagcaatgtgaaatttgctttcagctctaccgctagaataagtaaacagaaaaaaatcgtcaaccgcataattcgacattttgcggattctgtatgaaatattattttgtgtaacgattggcataactgaatgctgtgcaggaatcgggcttgattttcgcttcaatacccatcgaggtaatgcggccggtcatttcttgtatcaattcttttgtcagccctttttgaccgatatccagatgcacttcaaatgaaagatccgccccttcatccgcaaaaggcaagagcaaatctgtcagttccataagacagccgtcgaggatatgcgcagccatctcctggctgaacgcggtttccagcgagattttttcgcgaaggctatgtatcggtcttgcaaggtcgtgatttttcaaacagccccaagctcccttgcctgtacggtgcaagtgtatagccgtaataaactttgtgaagtcgcggtaaacttgtgaatcagtccctacagacagcacgtatgctgaacgggggtctttattgacaaagcgtttcagccgctccgtcacgtcttgaaaggtcatctgtgcctcagaaagattataaaacagaaaagaatcagccatgtacggacactcctctttccagagtctacaaccaaacgaacaagcacgttcctttgcataatttaataaagctccgcttgcggaagaccggaagcttggtcagcctgaaaaatcaaatcacattactgaaggagctcaaaaatttcaatagaaatcatgtcaatgttatcaaacggatatgtgttaggtttttcacctttttggaaaaccgtcagttcaaacgtttgatttttttcgaaatatttaacactgcaaattttttcgccgttaacttcaaaataacgctgcatcggctcgttagccgcttccgctgtttcttgcagactttgcagccgcgtgatgatacccattaattgtgacattctaaaaaaagactcctttcaaaaaacaacttcaaatcaacaagtatttattataatacaagtcctacagagcatcataccataaagtagaccgggatggcattttcccgctggattttcaaaaagaaataaacgggaaaaccgtgttttcgaatagtttgaagcttttttcggaatgtcatacacctttcaaaaataatttttcgctttttgagccgccattgtcagatgtatgtaaggagaagcccttttatgcgcagacagcataaaaaaacttggcggggtagcgccaagctttttcggatcttgatctgatagaggggttggggaacagagagtaacttctctctataactaaatgataatgattatcactatcattgtcaatcgttttttaaaactttttcacatttataaaaaaagcggcatactgcagccgctttaaagtaacccgtcctgttcatataaataagagtaaggcagatcgataaataaatacatattgtcatccatcgggtatgaaaaggttctgatcatctcacccgtctcaatatcactgtacaggtcactgaaaaagccttttcttgaattccgcatcttcataatgttttctaaaaagtacggacgccagctccagtttttctccacgtattcaggctgataaagccattcgccggactgcttgaacacatttcccgtcagctgatagccttcttcatcacacatataaattctgaaacagcagtcggtcaggttttccgccagttttttaataaactcatcgtccgcctgatgggttttcttcagttcggaaactgcctgattgacccgcttataaaaattctcagagtgttcgtatactgtctccagcttctttttttctctcgtgataaattgctgaaactccgttttcaagcgtgcttttaacaggctccggtctataaaatcgccgctcggcgcctgcagataataaccttgaaaaaatcggcctccgtttctccatgcgtactggagctgaaaatcagcttctatatcttcatacagcagcgcggcgccgatttttctcgccagcaatgaaatgctgtacagcacatgctcatacgaaggtgacggctgagatactttcagcgcctgcaaatctattttcagaaggtccggtgaaaggagcgcgattctgtccaggttgctgctctccttacctatattgtccaccgcgattttaatgccgtatgtacgatagtaggcaagcatatggtacagctgttcaatgtcgccttcgaaattgtgctcggtgatctcaagcacaatacggttcaattcaatgccctgctcttcgtattctttcaaaagctcaagaaagctctcgccgtggtcaagcatcaatacattcgcatcctgattgataaaaatcaacagatcgcgatcagcttctttaaaccgctccagcgcctgcctgatgactctgtcatcgacctcaagcttatattcttccgggatgccggaatctaagaaaaacggcccgaggctctcaatctccgcatctgccaaaatacggccaagcacttcgtagcctacgactctttgttcctcagcgttaaaaatcgcttggtaatacggaataacatcatcaatattcgtcagtatatcaagtgggtccaacatgttatcacctgcttctctatctttgtctgattatacacaattatatcagcaccacaaatgtttagattaggggaaaaaggaggcagtatggcagcagtttaaaataaaaggggaaaactttttaagatcactcttcagaccggttaattaaggacgttattcatttgtttcaccatcacaaataaaaggataaatataagagcatgataaccggcggctgtccaaaaataatggctccaatcagtactgttaaatatccaatcatcatcatgtttcaactgaaagaaagttccttttttatctaaagtgccaaatgtaagagttgttaacccgccagcactcttggaaacgtcaacttcatacattgaaccggcatgatcagtatgatttattggcatatacgtataatcagataaaattgtttccgccagcttggttggcagagacacatatcatacagccgatgtatcgcctccgagcccactcaaatactccctggctttaataaatttcgtttcatcaggaaaatctatatgatatagcttttcaaatctgattatttcatcagatgtaagattggtattttgataatactccggagtaaaagcgcaaatgataaagtaccaaatattaaagatgataacgaaactgcttacaaatagtacaacgaaccattttaataatttcttcacttattcacctcttaatctttaaaaattatatcataattttgaatagaaaaataaaacaagcgaacggtcacctttaacgttcgcttgttttgcaaaatatgtcatgtaaattaaaacgggtaaggattcagccattgccccccgtccattgtgatacaatccccgtttatataggatgcttcatcggatagcaaaaacgctgccaaagcggcgatttcctccggtgtccccagacggccgagcggcacactgttcatagtgcgggacaccgctttttccgattcaaacagcttctccgcaccgcctgtccgttcaatcgggccgggggctatcgcgtttgtgcggatgccgtatttgctcccccattcaacggccagcgttcttgtcagtgacaatacccccgctttggctgcagcggaatgaacgacacccgctcccgctccccatgcgtatgtagcggccatatttaagatgacgcccttctgctcctgctcgatccaatgccttgccgcggcttggctgcagaaaaatgtgccgtttaaaacaatctcaataacagctttccatccattgggcgtcagcttctctgccgggcaaataaaattgccggccgcattgttaatcagcgcatcgagccggccaaagacttttttcgcttctgtaatcatgtctgaagcggcggaatcagaacggacatccatttgaaaacaggcgacctgcccctcaaaggtctcaatttctttttttgtttcctcaagtgcttcatggttcctccctgtcaccatgacgtgccatcctaattcagcctgttttttcgccattgcttttcccatgccgcttgaaccgcctgtaatgattaccgctttcttatccataacaaacccaccccttttattgaatgaataatcattcataattttatcatagatgtctttccgcgtcattacatgctgagaagggatttttcagccaggctgatgatataatagaacaactctgacaaaggttggttttacatatggagaaaatgacgagaagaacatttttaaaaagaggattcggcattttgggtgcaactctcgcaacggcttgcggaggttacggctatgcccggtatattgaaccgcgcatgattgagatcacccgtcatacaatcaccagccgcctgatcccccgcggctttgacaattttaaaatcgttcaattcagcgatacgcatctcagtgatgtgtttacatccggtgacttgaataaagcagcggaaaagatcaatcagctgaaacccgatctgctcatctttacgggagatttaattgataagccgcatttatttaatgatcaccagcaagcactggccgtgctgcaaaatctggaagctcccttcggcaaactttgtgtttacggaaaccatgaccacggaggctacggtacgaacacgtacaaggctctgatggaagcggctgattttcaagtgcttcgaaatggctgccgtcaggtgcagctgacagacggaagccggattgaactcgcgtttttggatgatgtaatgctcggaaaacccgattatgaaggcaccctttcccgcctttccgaagatgcgttttccattttaatcgtccacgagcctgatgccgctctcaagatcggcggatatcccgtaaacctccagctgtcgggacacactcacggcggccaggtccagctcccgtttttcggccctctcattacgcctccatacggaaaaacgtataccgacggcatgtatacgctgcatgacacagccgtttacgtcaatcgcgggctcggtacgacaagactgccgtatcgatttttagccagaccggaaatcacgctgttcacattgaaaaccgtacaaaaataagacttttatcccgatgcacagacatcccctccgtaatatgtatatggaaaagagcaaaaaggagggtgacgaaactgctgacatatcaagtgaaacaaggagaaaccatctcaagcattgcgcaagacttcagaataagcactgctgctctccttcaggcaaatccctcaatccaatcggtcatatacgcgggacagcacattatcataccgaatcttcccgacccatccaccattccctattccattgtcgtgtatatcggagcgaagaaactggagttataccgcctcggcaggctcatccgtacgtaccccatcgcagtcggaaaaatattgacgaccacgccgaccggagaattttacattgtgaaccgccagcccaagcccggcggcccgttcggcgcttattggctcagcctctctaaaattcattacggcattcacggaacaaataacccttcctccatcggcaaagcggtatcaaaaggatgcatccggatgtataatcaggacgtcactgaacttgccgctaccgttcctaatggaacaagggtgaccattataagatagaaagatcttatttgttaatggaacgagctgatgataatatattacagtgggacctttagggtaaggagcgtgtttatggatatatttaaaaatcgcaattttgtccgtctctttttcgcagcactcgcttctcaaatgggaacgactgtaggtaatatggctttcgctttttacttgctggaccatttttcaaaccagccggcatacacaactttggctgagctgatgtattcactgccgacagttttcgtatttctgattgtcggtgtcgcagctgaccggcttgacaggaaaaaggtcgcagagaattgtgattggatcagagccggactgacgatcgtattatttgccgcattatacaccgggagcatccctctcgtgttctgtattttgttcatcagaagcgccgtgaccaagttctttttcccggcggaagccagccttgtacaagctattctgcctaaggagcattatgcgaaagcggcgggacttaaccagatcctgttcagcatctttatggtattcggcgtcggtatgggcgcgtttatgtataaaacgatcggtattcacggagccattatccttgattttgtcagctttattgtatcaggctttctgatccgcgcctgccgcattccgaaagaagcccgtcagccgaacggcccttttaaatggggagattcgtttctgaaagactcggtcgctgattttaaggaagggatcgtatatattgttaaaaacaaattgcttgcttcccttattttcggcttttttatctttggttttgtcaacggcggctttgccgtactgccgatgtttacgatgaaatacggacttgcgcctgatcattacgaatcacatacttccatcttcaccgtcgcactcggcttcggcctgcttgcaggaagtgtgatcggaacaatgatcgcaaaaaaagtcaaaccgcatcatttgatgtcgattcctattttggcagccggactgctcatttttgtcctcggctatacggataagctgtggatttattatgcggcggctttcatcctcggcatgtgcatcggccctgtcaatatcgccatcggcggctggatgccgaaaatcgttcatccgaaaataatgggccgggtcagcggctggcaggatccttttatgatgtttgcccaatcgattacactcggactggttgccctgttatttccgaaattcgtttccaatattgattacctttattacggcatgggaatcgtgattttagcggtatttgtgttctattttatcgctcttccgaaatacagcgccgaggcagcagaggtcgatgtgcagcaatcattaaaggctgattccgaaaaacatgcgaaacctgtctaataaaggaaaaaaatgcgcccttttcatcagaaaaaggcgtatttttataatcaatatttgcatttcaacgctaaaaaagtataatctatatatgaacttgatcaatgcaaaggagagaaataatggacgaccacgcttattcgaaagagctgcagccaaccatcgagaatctttcaaaagctgtttatactgtgaaccgccatgcaaaaaccgcccccaaccctaaatacctttatctgctgaaaaaacgggcattacaaaagcttgtgaaagaaggcaaagggaaaaaaatagggcttcacttttcaaataatcccaggtttagccaacagcagtcagacgtacttatctctatcggagactactattttcacatgcctccaacaaaagaagacttccagcatcttccgcatttaggtacgttaaatcaatcgtaccgcaatcctaaagcacaaatgtctttgacaaaagcgaaaaacgtattgcaaaaatatgtgggcttaaaggaaaaaccgcttgccgccaacaggcagcagcccgcttatcataaacccgtatttaaaaaacttggtgagagttatttttaattccgccgcaaaaaagccgatgcgtcatgcatcggcttttttctattcaatcacgtacgtatccacttttttaatgagctcgctgatttcaggcttgctgatctgttcatccgctccgactacttcgccccggtggcgcaggtcgtccgtaatgagggacgagaaaatcataatcggcacatcagagctttgcgggttatccttaaggagcttcgtcaaacgatgcccgtccattttcggcatctcaatgtcactgataatcatgtcaatatgatctgacaggtttgctccgttatccgtcagttccacgacgtaatcatacgcttcttttccgttttcaaatgtaacgatttcactgtaccccgcctcagtcagctcatccgtcaaaagacgcatcagaagcggcgaatcttcaacgatgatcagttttttacccgcccgtctttcatcaaatccttcctgatggacatgataagtctcaactccggatgccgattcaatatcgtaaatgatcttttcataatcaggcagaaagatcatcgtgtcttccagtttgatgattcccgttaaatgccgctccatgccctggttcagggaagtcggcttttcaatcgcctcccaggacaccctgtggatttgtgaaacggaaccgacgtgaaagacgattttccgcttgttgaattccgttacgatatatttatcgtcttttgctccttcggcatcaacgccgaaaaaggaatacagactgatgacgggaagaatttcgcctctcagcttaatcatcccttctacgtctttatgagactgaggcacagatgtgacatctaccggctgaatgatttcccggactttcatcacatttatgccaaatgtattgacgcctacttcaaatttgacgatttctaattcgtttgtgcctgaatccaataaaatatcgtattgttgtaaagacaattcaatccctcgctatccgcattcagtattgtactgtatatatcggctgtaaacggaaaaagtgaatgtattcgggccaactggccatgaactctttataaaaagatgcttttttctgatatcccattgactttttgacatcgagtggtaaaatagtcaaggatttttcaggaagaagggtgtaataaatgggtacagtagtcatattcgaccaagatcaaatgacggtgttagaagatatcagcaaaacggcttacctgcaaatgaaaaaagaggcgaaagagcgtcccgacaagcccgctccatacatcttatggcgggaagacgtcagctttgaatacgggtattaatgacattcgccacatatcacaatagatagatcatgatacaatgaagacaatcatttcagctggttgtcttatttttttctgaaaaaaggtatgttttcacatatcggacatatactcgggatagttcaataaaaagatgacaaatgctcagctagtggtaaaataggataaactcaatatatagtataaggtgatgaattatggaacatttgcttaatccgaatgtaaaagaaattgaaatttcaggaattcgcaaattctcaaatcttgtagctcagcacgataatgtcatttcgcttacgatcggccagccggatttcttcacgccgcaccatgtcaaagcggctgccaaaaaggcaatcgacgagaacgcaacggcatatactccgaacgcgggcggccttgagctgagacaggccgtacagctttatatgaagaaaaaagctgatttgaattatgaggctgaaactgaaatcattgtcacaaccggagcgagccaagcgattgacgcgtctttgcggacgattttatctccaggcgatgaagttattctccccggaccgatatatccgggctacgaaccgatcatccgcatgtcgggcgccgttccggttcatgtggatacgacgacacacggatttaagctgacggcgcggcttattgaagaatcgctgacaccaaaaacaaaatgcgtcattcttccttatccgtcaaatccgaccggtgtgacattgtctgaggaagagctgcaaaacatcgcagccgtcctgaagggcagaaatgtttttgtcctgtctgatgagatttacagcgaattaacctatgacagaccgcattattcgatcgcgtcttatttgagagaccagacgatcgtcatcaacggcctgtcaaaatcacacagcatgacgggctggagaatcggtttcattttcgcaccgaaagaaattgccaagcacatcttaaaagttcaccaatacagtgtgacatgcgcgtcttcaatctctcagaaagcggctcttgaagcggtgacaaacggtgttgatgatgcgcttattatgagagaacagtataaaaagcggcttgactatgtatatgaccgtcttgtttcaatggggcttgacgtcgtaaagccgtcaggcgcattttatatcttcccttccattaagtcattcggaatgtcatcgtttgattttagtatggctcttttagaggatgcaggtgtggctcttgtgcccggcagctcgttttcaaagttgggtgaagggtatgtgaggctgtcattcgcatattcactggatacattgagagaaggcttggaccggctggaagcatttattttaaaaacgagagaatccatgcagactatttaaacaacggcataacgccgttgttttttttattgtttcgggaatgtaatgtgaaaggccgtgcctctgtccggtttgctgtctacttggatggctccctggtggtttttaataaggttgaatgtgaccatcagccccaggccggttcctttttctttcgttgtcaaaaacggttcgcctattcgtttcagcacgttttccggtatcccgtcgccctcgtctttcaccgtcacattaacggaatactcatcttctgtcatgatgatgtgaaccgttcccccatccggcatcgactcaacggcatttttaatcagattgataaacacctgtttcagctgattttgatcaccgttaatatacatgctgtcatgttcgtaatccgttttgataaaaatccctttaagattcgcctgcgtctctaaaagagcggtcacttcacttataattttctttaagtttacacgctctttcacggcgttttgctgaggtttggcaagcattaaaagctcacttaaaattaattcgattctgctcagttcggaaaacacaatttcaaagtaatgttcgttttcctccatcgtcggcttcatgagctgtaaaaatcctttgatcgccgtcagcggattgcggatttcgtgagcgatccccgccgccagctgccctgcgatagacagcttttccgacttcagcattaattcctccgtctgcttccgctcagaaatgtcacgcagaatgacctgcacggccgtttctccgaaaaacgtcgtcggaatgcagaccatttccgtgtagatcagccggtttttaaaggtaaaccacgattgcttaatgatttctgactcggtctttcggttgataatattttggatccgctgtttcacgccgtcatgatcacagggatgaagctgatcatagacgtttttcccgattaaatcttcatatgtttcagcctcaaacagcgaaatgcccgattcattcatgaatacccacttatcattgtgaatcacggcgatcgtgtcaattgaattctgaatgaggagctgataacgctctctgcttttttgcagaatcgtttggaattttttccgtgaagaaatatcaatcagaagcagcaattccgcccgctgatttttatatgtcgtcggtgccgccttcacttctaaatgaacgggcgtgccgtcgagccttctccacgtctgttcgatcattccgacttccattcctttttgcatccgcacaattcggtttttcacaatgtcgtgatactcttcttcaataaactcataggagcgcctgccgattacctcgtctttgctttcggctcccagcatggcaagcatcgcgttgttggcgtaggcgattgtgccgttgatgctgacatataaaggattcggcagcatttcaacaagacgctcgaattcgccgtttccagccgcatcttccgactgttgttctgccttttgcttcttttgttcatacatataaggccggcggggcgtcttctcctcaagcaccttgattttgaggatgatttcccgatccgtcccctccatttgcggtgtgacaatttccacacccgcttcaagccatacgatggtatgatcttttttaataagacgaaaggtgcaaggcatcaaatgatgctcattatagaagtaactttcaaccaaaaattgatcttcttcatgcaggaacgttttgagaaatgacccgatcatctcttcctgagaataactgaagtacgatttacagtttgcggaaatatacataatacgcccgttagacgtcaaaacggcatgaagatcggttttcgattgaaactgtttgacatgctgagtatcctgttccacagaatccctcctttgcattatactcgcactgcaggctggacacggactgatataaaaagaaattccactagattgattcgctaaaaaatgagcattctccttctattcttattgtgaacgtcaattttcctgaatgaaagaaagggcgcacgagatgttcggccgccctttcatttgttattttttattgtatttcttttcaagttctttgtaagcgtcaattgctcccttagcaatgtttttgcttacatgatctttatcatttccaacagacggaacgacgacgctgaatgccactcttggatgctctgacggataatagccgacaaaggtcaggttatacgtgtacttcccccaccagtttttgttcgtgccgtaatagtgcgtctccgcggttcccgtttttccggaaacatcagcgccggaaccttggaatgttgaataagccgttccttgaggtgagcttgtgaccaatttcattcctttatgaacttggtcaaaatcgctcggactgttatttactttgttcaaaattttaatatcccgctgttcaatcgcttttccaatcttatttttgctgtccggttcatgaatgcttgtgacgatccgcggctggacgcgatacccgccgtttgcgatggctgaaatatattgagccatttgaagcggcgtatacgtatcaaactgtccgatcgcaaagtcaagcagcaatcccccgaccatttgcggatttgactgcatgcccgctgattcctgcggaagatcaatcccggtcttcacacccaaaccgaattgggcgtagtagttgcgcatttttttaatatcgtctaatccggcaggcagcgtgccgtacggcctgtaggtaatgccggcgatatgcatggccacatgaaacatatacacgtttgaacttctttgcagcgcggtcagctcagtaatggctcccatttgtgtccacgattgttttctcgttttgcctttaaatacaagcggtgcatcgacaaacgttttataatgcgggaggccgctttggtaacccgcgagaacagtcgctcctttaacagaagagcccatctcatattgggtcgtaaatgctccgatcgcaaaatcctgtgttttatttgtttcgagatcgatgcgtttccccgccattgagagaatatccccgttgttcgggtccatcatgacggcaaatcctctgtcaaccatatagttgcctgcggcgcggcttcttctcagctctttttcaatgactttttcgactttcgactgtaattccatatcgagcgagagttgcagatcgtagcctctgctgccttcatcgacgggcttttggctgacgacctcacctttgctgttttccacatactctactttttctttatgcgcgtttaaatagtcctcatactgatattcgatgtagctttttcccacccggtcattcagtgagtagcctcttgtgacatagtaatctttccgttcgcccaacaatccctgttccggtgtcgtcacaccgccgaacagagagtacagcgttttgtcgtatggatattttcgcgtccagtcattgatcacgtcaatgccggggagctctttcaggtgctcggatacgacggaaacttcttcatatgtcagatcgctttttggtttttgcttgttgttttcatgctcgtcaagcaatgaaccgctgtttccgtttccgttcagcttattcgggtccattgatttgacgacttgcggctgataggcgttgccgcttgaaaaacgcgtataaatcgccgcaatttgcagctcttttttatcttgtttgatcgcatcaatctcctgcttcggaacgcgttcaatctggcgtttgtacacttcttgggatttcaggctgttttctgaatccttcataagcttttccgccttcttcggatgtgccgcaagccagtaatcaatgatatttcgatccttcataaattcagtatcaatatgaatcagtgcggcgagattttttgccgttttcaatttgtcctttgccgaggtttttgaggtagaaacgtatacaatttcaggcacagcctggttatcaaccgccaccctgttccgcttgtcatacatttttccccgcggtgtcggataataggcggtttttgcatttgccttctccgcatcctggcggtgtttatccccttcgacaatctggacgatgccgagtttaaaaatcagtgccgtaaagagaagaaacacaatcaaaaaatagagattcattctcagcgctctgtaacgtttcgtttttttctttggttcgcgcgcgacttcagccactttctgttacacctctcaaatcattgaatatatttacataaacagattttaattgtaacatttttgtaaaagttgttacagcgaaaacgggtaaaaaaaactgtcaagatcaaattatcttaaaatatatctaacacttcaaataatttgaagagatgtaacggattttaaaaaataaatacagatcgtttttactgatataaagccatttttctgtgctcaattacaattatgacaaacgtttgttgtcaaaggaaatggctgcctgcattatgacaaaaaagctgtgataagatttttcatgtagaaaaaaacaacttctctgggaggctataaacttatgaaaaaagcatttctcttatctgccgccgcggcagtcagtttgattacattcggaggcattcagcaggcatctgcaaaagagctgtcatgccagcacgtcgttactgtgaaaaaaggaaacaccgtacagcatctgactcttcaagaggctgttgaaaaactacatatgaaaacgagcgtgaaaaagctgaacgttaaaaatgagaaagaactgactcagctgctgcaaaaacacgcaaagcattctgatatgacagttaaagacgttcaaaaagaaacaccggaaaaaacggccccgacagctgccgaaaaaccgaaagccgatcaaaaccagacggctgacaatgcaaagcagacagataatacaaacaacagcagcgagaaaactccttcatcagtcagtgcgtatgaaaagaaagtcgttgaattgacaaatgcagagagacaaaagcaaggcttaaaacctctgcagattgatgaaaaattaagcaaatcagctcacgcaaaatcacaagatatgaaagacaaaaactatttcgatcaccaaagtccgacttacggctcacctttcgatatgatgaagtctttcggaatcacttataaaactgccggtgaaaatatcgccaaagggcagacgactcctgaagccgtcgttaaagcttggatgaacagtgaaggccacagaaagaacatcatgaatcctgagttcactcaaatcggtgtgggttatgtagaatcaggaaacatctggacacagcaattcatcggaaaataaataaaaaaagattgcccggcgggcaatcttttttttatttcacccaaagcttataaatgctttgagttccgctgttttcttcaccttgcgcggaaagcttgtcgtacaatgatttggccagcgccaatccgggcatttcttctcccatgagctccgcttcttcaagggcaatgcccatgtctttaataaagtgtttcacgtaaaatccgggcgcaaaatcgcctttcagcatacggggagcgaggtttgacaatgaccagctgccagccgctccggttgtaatgcttttcagcacttgttccgggttcagaccggatttttccgcgtaagccatcgcttcagccactccgaccatccccgctgcaatcgcgatctgattgcacattttcgtatgctggccgctgccagccggcccttgatactgaatattttcccccataacggagaaaagcggcaggcatgcttcaaacgcttctttttctcctccggccataatggcaagcgttccgttcctcgcgccgatgtctccgccggaaacgggtgcatccagggcgtgaatggacttttctttggctttctccgctattttcttcgccagagatggttttgatgtcgtcatatcaatgacaaacgccccttcttttgcatgacggagaatgccgctttcaccgagatagatttcctcgacatcactcggatagccgaccatggtaataatgatgtctgctttttccgaaaggtctttgaccgtctcctgccagaccgctcccttattcagaacctcttccgctttgtgtttcgtacgcgtgtagactaaaacaggatagcccgcttctaaaatgtgcgatgccatactgtttcccatgacgcccaaaccgataaatcctaccgttttgttcactgcgctttcctcccctgatgcgattcatatatcactctttcatgtctatattaccatattataggctgatagagaccgcgtcacaaggtgaatttagaaatggcgctgatcagatcttcgcttgcgctctttaacatatcagtcgattgcttcactttttcaagcgtaacgagctgttcatcagtagaagcattcacttcttccgccgctgccgcagattcttgagaaatggcggagatgctttgaatcgcttcttgaatcgaggcttgttcttcactcattttttgaatgtcattgtaaatatgatctataccttgaacgagagactgcatttccgttgtaatcagattgagaacctcacccgtttcatgaatggcgctgttttgttcatcattcattctgcttgcctcaatcatcgcgtgtgacgcttcttttgtctcagattgaatcagacggaccgtctcactgatatggccggaagaaagagctgattgttcagcaagcttgcggacttcttccgcgacgacggcaaagccccgtccgctttctcccgctcttgcggcttctatgctcgcattcagcgccaagagattcgtctggtctgaaatagcggatattgccgtcacgacttcttctatgtttttcgtttgttcttccaggtcattcagcattgcctctacttttttcgtttctgaattggcttcgtttgacttcatcagcagctgcccgagcgcgtccaatcctttgtagctggcatcctctgaagattttgagagttgttttatgctgcctgcgcgatctgcgattccttttattttgactgagagattttctgatttttcgttgatcgtctcaacctctgacgcttgctctgtcgctccggcggcgacttcctctatcgcttttgcgatttgtccgctcgtttcatttgtttcttgtgaaatgacggttagctggtcagatgtatcagacacattttctgaggaggccttgacctgttcgaccatctctttcatattttcaaccatttggttaaagtcttttgttaactcgcctacttcatcttttgatttcgtctgggcgcggacggttaaatctcccgctgagactgaatttgtttttgcgatcagctgctgaatcggcccggttatcgtttttgcgaggaaatagctgagtccgatcgtaatcacaagggcgatcagtgacataaaaatgctcaccgtgttcattttgtcggctactcccatcagctgatctttttcaaactgcgttccgactttccaccctgtttcttttaccgtttggtagacgaccatgttcccctgcagctctttgatgccttctttgtccgcagtgatgtcttttaacgtctgatcttccgaaatattttttccctgttttgccggatgggccagaagagagccgttttcatccgccaaaaacgcaaatcctttatacggaaccttttgctcgttgaccatgctctgaatggaggacagcttcaaatctaagctcgccactccgacgacggttccgctgttttgaatggcttttgacgccgtcacgatcatgtctcccgtcactgcatctttataagggtcagtccagacaaccttatcgggtttttcagccgccatcttataccacgttcgatttgtcagatcatagtctttggcaaaatcggcctttggatatgtaaacatttgtttgtttgcggttccgacgtacgcaagcgcgacatatttgtcattctgtccgatctgttttaactcatcgttaaaaagccgcgcggtttctttcttcccatctgatagaaaagaccgggacaattcaccgtctgctaatctcattaatacggtctcatcatttttcagctgaagctcaatgttctgaccgagtgaattggtgacattctctgtcgtacgttttgcttcctccgtcatcatcggctttaatgtcaaatatgaagaaaccgttaaaaaaacaaccgttacaataagcattgccgatacaaacacagcaattttgatatgcatttttttaaacataaccatcccctcctgagagttatatcggtctttcggccaagaaaatgaataaatcttgaaataaatatcaaacatttccgtcatttgtcgcagcaaaaaaaagagccgtcatgccgacagctccgccttacgtaaaatattcgattttcgctttcggaaaataggtttcgatataagattcgagtgtttcccttaaggcatgttcttcgtctttttggtatatatatttgccgattccgtagcgtccccatttgtacctgcgcttttcttcatcaagctcaagctttgttttcggatagttcttctcaatcacccgtttggccggttttgtaaaacgatgctggatcagttcaaatgtgatgtcatgccgaacgtcttcatcaagcgccgcatccagtttctcaaacagctccttatagccttcctcccagccatcatgaatataaataggcgccacgatgaaaccgagcggatagcccgctttagcgactttgacggcggcttcgatccgtttgtcgagcggagaagttcccggttcaaagttttttatgacataatccgcattgatgctgaatctgaacctagtctttccgttatgttttgcatcaagcaaatgatcgacgtggtgaaatttagtcacgaatctgagctgccccaattcgctttgtccgaaatgttcaatggctctttttaatgtatgtgtcagatgatcgattccgacgatatcagacgtacaagaggcttcaaatcttgtaaattccggcgctcgttctttcatatactcatcagcctgatccagaatctcttctacattgacatatgtccggatgtaaggctttgaccccatcgtcgtctgcaggtagcaatagtggcaatgccccatacagcctgtcgcaaatggaatggcatattcggcggacggctttgaagaatcgaatttcagtgttttccggacgccgattaccaatgttgatttcgcgttccggtattgctgcaagtgatttttccccggaatattccggacttgattatgcgatgttgtttctctgatctcaagccccatattttcaaacttattcttcagctcttgtcctaacgggtattcgagcgctctcggttctatataaacaagctggggcacaaacggcttcagcatgaactgacactcccttttttcatattctcatgttgttactttccgtttaaaagagagtgaatatgcgttgtaaacatttcctttgatcaatgatatcggtcttcttcaaaaagctcgctgtaaagcgcttccgcttcctcatatgttgaaaagaccgcgtcatcttcggccagcggatgataggtttcgtataaaaacagagacagttctccctcatgatatgggtgatggacgatctccgcctctttaatatgggcaacattggcggcatgcggattgcggtaaatcacatagaccgtatcccccgctgcaaatgattttgtcataataatccctcctgttgaacgttattgttccccccttttttccgaatatgaaaaaaaccagacggcttataccgtctggctgttgtattacttattgaatgtttctttaacgaatgcgacaacctcttctgtcgtgctcatagacaagattgtttctttgaatgattcagcttcttttttagaaagcttgctgatctgcgttcttgccggaaggatggatgtagcgctcattgagaactcatctaagcctaagccgagaagaatcggaatcgcaatttcgtctcccgccatttctccgcacattccgacccatttgccctctttgtgagcggcttcaataacaagggtgatcagacggagaatcgccgggttgtatggctgatacagataagctacgcgctcgttcatgcggtcagcagccatcgtgtattggatcaagtcatttgttccgatactgaagaagtcaacttctgtagcaaactgatctgcgataacggctgtagacggaatctctaccatcataccgacttcaatatcgtcagaaaccgctacgccggcttcgacgagtttttctttttcttcgagaagaatcgctttcgcctgtttaaactcgtttactgtcgcaatcatcgggaacatgatttttaagtttccgtatgtacttgcacgaagcagcgcacgaagctgagttctgaagatttcttgctcttcaaggcaaaggcggatggctctgtagcctaagaacgggttcatttctttagggagctgcaggtaaggaagctctttgtcgccgccgatatccaatgtccgcacgacaactgattttccttccatacgctcaagaaccgttttataagcgtcaaactgctcgtcttccgtcggaagctggtcgcgtcccatgtaaaggaattccgtacggtaaagccctacagcttctcctccgttttcaagaacgccttttacatcgtcaggtgtgccgatgtttgcggcaagctctacatgatggccgtcttttgaaacagtcggttcattgacgagcttcgcccactcagctttttgcgccaggtaagcactgtgcttttcttcatatttctttaacgtttcactggaaggatcgatgatcacatcaccatcgatgccgtctacgattaccgtaacaccgttttcaattgtccctgtagccgcttttgtgccgacaacagccggaatttcaagcgaacgggccatgatcgcggagtgtgaagtgcgtccgccgatatcagttgtaaaaccttttacaaactggcggtttaattgcgccgtatcagacggtgtcaaatcttcagccacgataacaacctcttctgagatcatgctcgggttcggaatttccacgcccagcaggtgccccgtcacacgttttgttacgtcacggatatccgccgcacgctctttcatgtattcgttatccattgattcaaacatagtaacgaacatggaagctgtttctttcaaagcgaattcagcattgactgaatctgtgctgattttctcctttaccgggttcagcagctcaggatcactcagaactaaaaggtgcgcggagaaaatgtcagctttgtcttgtcccagttcttttaaagcatgctctttaattttttcaagctcttctttagaacgtacaatcgcttcatcaaaacggcttacttcagccgcagcatcagcaatgtttttcttttcaaccgttaagtccggctcttcaagccggtatgctttcgcaatcgcaattccggctgaagcgcctattccttttaattcttgcattactcgccgagtccttcgcttttcattgtttcttctaaagcgttaagagcatcgttttcgtcagcgcctgaagcggaaattgtgatttcagcgcctttagcgatacctagagacataacgcccatgattgacttaaggtttactgttttgccgttatattctaagtttacgtcagcatcgtatttgcttgcagtctgtacaagaactgtcgcaggacgagcgtggattccggaatctgctgttactttaaatgttttttgtgccatgattatcattctcctttaaattaaagctattttactacacaatattatatcatacagccgtacttgtcatctgacaagcacggcgtatttatatgcttattttccgattttcacaatatctttttgttcccgttttacggtaccttcggccgaaagggaaatcgcttcaccctcggcaagatttgtaaagacaatcggtgtcattaatgaaggaacatgaggtttaaccgcttcaagatcaacttcaagcagcttttgccccggttcaacccggtcaccctctgaaacaaaagaagtgaatccttcgcctttcaggctgactgtgtcgattccgaaatgaatcaggatctctcttccgccgtcagactgaagaccgatcgcatgttttgtcgggaaaacattcagcacttttccgcggacaggcgatacgacgattccttcttcaggaagaatcgcaaaaccgtcacccatcatttttcctgagaacacctggtcaggcacatcggtaatcggatggatttcgccggtgatcggagaagcgaacacttcttcaccctgctcgtttcggagcggatctgcgataacctcctcaacctgctggctgacttcttcttgtgcggatactttcggttcagggcgcggcgtgcgtccggcgataatatcctgcatctgtgtttttaaaccgtcagaacgcgggccgaaaatggcctgaatgttgtttccgacttcaagaacgcctgaggcgccaagctgtttcaaacgagtcttatccactttcttctggtcgttgaccgtaacgcggagtctcgtgatacaagcgtcaaggtgcttaatgttttcctggtcacccattgcctgcaggatttcataaggaaggtcgccggcttcgcctgaggcgcccgcaccttcatccgcagcctcttcttcacggcccggcgttttcagattgaactttctgatcgcaaaccggaaaccgaagtagtaaataacggctaatcctaggccgaccggaatgacaagccaccaagcggtccggttaggcagaattccgaacaggaagtagtcaatcagaccgcctgagaacgtcataccgatttttacatgcagcagctgcataaccataaaggaaagtcccgcgaatacgcagtgaatcgcaaacaggataggagccacaaataagaatgagaattcaagcggctcggtaattcccgttaagaaacttgtcagagcggcagaacccatgattccggctacaagttttttcttttcaggcttcgcttcatgatagattgcaagcgctgccgccggaagaccgaacatcataaacggatatttccccgtcataaatgttcccgccgtcagctgtacgccgtctttgatctgagccatgaaaatccgctgatctccgcggatgatgtctccggccgcatctttatagctgaaaaattcataccagaacggcgagtagaaaatgtgatgaagaccgaacggaatcaatgaccgctcaatcatcccgaaaataaaggccgccaaggttggattcgcttccacaagacccgtggagaaggaattcagaccgtgctggatcggaggccagatcactaacataataagtccgagaattaatgcggaaattgatgtgataatcgggacgaaccgcttacccgcaaagaatccgaggtactgcggaagttcaattttataaaacttgttgaacaataacgcggccaggaccccgacgataataccgccgaacacgccagtcgccaaagtgggtatccccagcatgttaatataggccggatggttttccgcaaaaaactttgcccgttcaattttgtcagacggaatactgccgttcgccataagcacggcgctcatggatacgttcatgaccaggtatccgataatggccgcaattccggcaacaccgtctccgttggcaagaccgatcgcaacccctactgcaaaaagaagcggcaggttgtcaaatacgatttggccggcgctttccatgacgttcgccacaagctgaacgttatcattgcttaagaaatgcatgacttgaatcatatctttgttctgcatggcattccctaacgcaagcaagatccccgcagccggtaaaatcgcaaccggaagcataagagcacggccgattttctggagaacgccgaataatgctttaaacataaaagatgtacctcctctgttagctagtgtgaccttacagcgaaaattcatgacaacgaattcactggcgcaagtcttcagtttaaccgtttacatttgcccttttacacaacaaaaaaggcatgagtaaaaagggtgtgcaaaataacgggatcgttcttcccgttttttaccctcaatcactcatgcctgatcgaatcagtgacacgtttttaaggtttcaactgaaattatgaaattttattggttaatcggtacaaatgaagcgtgagataaaccgcttccgcctcatgaactggttttttcagtatttgctgcaagatttttatcagtttccaagcagtattgtagcatagcgggtattcatttttcaataataacattaacttttctggttcttttgtctgctcttcccgattaatcctgtctatggtaaatctgatatgccggatcagccgcaaatagtggacgctttctttattcactttcatctggaaagagtcctcaatcacctgaacaaggcgggacatcagctgcgaatgctgattgacctctgaaaggggccgattcgtcagggcggaatggatatgcagagcgataaagccgatctctccttcaggaaggcagattcccgtcttttcattaatcatgccgacgacttcacgggcaatttggaattcttccggataaagcgtttcggtttccatgagaaacgggtttttaatgtcaaacccctgctgcagccgctttaccgcaaaggcgatatggtcagtcagcgcaatatggatatgctcatttaacggttggcttgtccgcttcttgatatgataaatgacgtcattggagatgtcgacaagtgtctcgtccacataaccgaggagctttttaaattgtttttgttctttttcatcctttaagatgaacatcttgtcataccctttatcttcaatgacatccgcttgtttttttccaaagccgatcccttttccgattaagacgacctcactgtatctatcatgtgttgcgatgagcacattgttatttaataccttttcaactgtaaaggaccccttcatgatcctcagctcctttgtcattcaatacctcatatcgtacaaaacgaacggaaagcgcgtcaattctttttttagacggttgatcgttcaataaggcggtaatcaagaactttccttcccggaggcccgccgctgatccggttctcaagcatgtgaaaagcctgctttcccatttctttcgtttgtatatctattgtggaaatacctaacatcttgctgatatcatgattgtcgatgctcaaaatcgcaagctcttccgggatgcgcgtcccgtttgccttggcttcaaggtaaagacctgcggatacttgatcattcgccgcaaacagcgcagtcggtttgtcatcccagctcttccatctatgaaaaagggctttcccgtcaagcagcgtcagcaccttttccacaaccagctcttccctgtaaggctgcccgatcttcttcagcgcctctttgtatgcggcgattcggacttgactgttttttcccttttttctggccaggcagatcgctattttccggtgtcccttttctatcagataatccagaccgtgccgaaatgcttcccgatgtggattactgatggaggaaagccctgccgcatcagtgtactggcagaggatgagcggttctttcacggcaagcaaatgctcatcaggaattgctttggagcagataatcaggccgtccacttggcgctcctgtaattgtgataaggcaaaacgttctttttgctgctcataatctgtctggtataaacaaagatgcacgcctgacgcttcggcagcctcggcaatacctgcaacaaggtctgcaaaatacggaaggttcaccgacggaagcacaacgccgatcatatcggaaaaacctttggataaatgaacagcatgaatgttgcgcgtgtatccgagcgattgcatcgcttttttcactctttctcttttgtccttacttacataaggatgatcgtttaaaactcttgataccgttgtaacggaaaccccggcagcgccggcaatgtctctgatcgtagccatggcgtcccccctttctttttttcccttgatctggaatgcgtttcatacagtaagctagaaacagatacatcctatccgtttgaaaggagaagaacagcgatggggattctttgcttaatcggtttgtgtctggccatactcggcggcagttaccttgccctgcggcccctgaatgaaaagcatgacatcaaaccatttcagcattttgatgattttttcatttaaaaggtgataaaaaaggacgctgcgttccagaaccgtccttttttatcacaaagctttctatttcagaatcgttaattctttcggatactgcgttaatgcttcggcgccgtcttttgtgacaaacacatcgtcttctatgcgcacgccgccgacatccggcacgtaaattcccggttctatcgtgtacaccatgccttctttgaggagtgtgtcgttcgcgctgctcattgatggatattcgtgaaccgaaatcccgagtccgtggccgaggcggtgcgggaaatagtctccgtatccggctttttcaataatgccgcgggcttttaaatcaagatcgccgattctgacgccgggtttacttaattgaagcgccgtctgttcagctttaagcaccgtttcgtaaatctcttcctgtttcgggctgattgattggtatgcgaatgttctcgtaatgtctgaacagtagccgtcaagaataacgcccagatcaaacagaacaaaatccccttttttcaaccggtctgcacccggattcccatggggctggcctgatttttccccgaacagcaccatcgttgaaaatgacatgccctgcacaccttttttcttcagctcaaactcaatctgcgcgagtacttcggtttcactcacaccctctttaagcgccgcgacaccgacttcaactccgtaatccgcgagttttgccgcttccctgagaatgctgatttccttctcatcttttacgagacggaattggttgagcgtttcttctgccgaaacaaatgccgcgcccccagaagcttgtttgagctgttctgagcgggaaagagagatcgaatccttttcaaccgcgatggaatcaagcggcacatttcgttttgtgagctcggctttgatcagctcccacggatcttcgtgatcgccgtagccgataataccatgctcccaaccggcgcttcgggcttgtccgtcttccattcccggacaaacgaaaaacggctcctgttcctgaaacaggaacaatcccattaaccgctcatgcggatccgtgtaaaaatcagttaaataaaatacgttttcctttgtatgtataaacgccgcatcatgtccttcttttttcagccaagatgaaacacgttctaatctgttcattttttgattttcctccttaccaaagtgactctttattcattctatcagttttccggcgtttatgctgtgaacgaacattaaaaaaacagccgcccgatgtgcggctgtcatgtttattttaataatctcagtccgttcagtataaccagaatcgtgctcccctcatggccgattacgccaaacggcagttccatcacctgcagaaagttagcgcagatcaaaaggcagatgaccgagagcgagaaaacaatattctgcttaataatccggttcattttccttgaaagtctgcacattttcacaagcttgtgaagatcatttttcataaggactaagtcagccgtttctagagccacgtccgtgcccccgcccatcgcaataccgacgtcagcggttttcagagcgggcgcgtcattaatgccgtctccgaccatggcgattgtgccgtacgtttctttcagcttcttcacttcttttgccttttggtccggcagacaatcggcaacaaccgtcgtcatgcccgcctctttcgcgatggcagccgcagtttcagactgatcgccggtgagcatggctgtttgaatgcccagtgattcaagctcagccatcacggctttggcttcaggccggatttgatcctttaaggcgaagcagcccgcaatccggtcttctttcttaacaaaaaccagtgtaaagcctttatcctttaattcttttcccgatgtctgcaaaaaagcatctgccgcatgttcacctgcaaatcccgcttttccgaccatccatttgacgccttctatttcagcctgaacaccgaatccggacgtctcgtcaatcgatagatggcctgcgggcgcggcgccccggctttcggcaaattcagctatcgcttttgcaagcgggtggcttgattgcttttctatcgcatataccgcctgcatgatctcatcttcactcacattttccgctgcttgaaatgccgcgactgccggctgtccctttgtgaccgtgccggttttgtcaaatgcgatcatccgtacgcttcccagctgctctaaaaacacacttcctttaaccaataatccgttgcgggccccatttgagataagggaaagcgcagcgggcataatagaagcaacaagcgcgcacggggaggcgaccaccataaacaccatcgcccggtaaaaggtttcactccagctccagcctaaagcgaaatgaggaacgaataaaagcacagccacggctaacagcacgcctttgacatagacactttcgaatcgctcaataaatgcctgagccggtgacacgctgttttgggctgattccaccagccggatgatttttctgaataaagactgttcatttgttttcgtcacacggaccgttaaggagccgtttccgtttaccgttcctgtaaacacagaatctcctgctgttttttccgccggcatcgcttcacccgtcagcgccgattcatcgaggctcgtcacgccagactcaataatcccgtctgccgctacgcgttcgcccggcttaatgacgatcatgtcaccgatcttaagttcagcagccggcacccgcttttcccgtccgtccgcaagcagggtcgcttcctccggttccagtttcatcaaggatgttaaatcacggctgcttttattcatcgtatatgtttcgagcgcgccgcttaacgaaaaaataaagataagaactgcgccttccgcccaataaccgatcagggcggagccgacagccgcaaatatcatcagcagttccacatttaacgccttcgtctcaatggtatcctcaattccctcttttgcttttgcaaatcccccgatcaggaaggcaaggatatacaaagtgacggacaggccttttgtttcggtaaaaaaccaggccgcaagaataaggacgccggatacgagcgccgcaatgagttctgcatgctggagccacctttttccggcccgctcttcttgtatcttctgctgttgtgaatgggtttgtgtcatcacttgttcattcattatgaattctcctctctaattgagaacgcaaatcatcttcaattccctgataaaagtaaaacagccgcctgacaggcagcattttcacagtgttatcgcagtgttttctttattatagcatgccggcggaagatttcaattataattgttttaatttctttatgataataattatcattagtgtttcttcagctgttcattatatgcaaaaaaggtgcgggaggaattcctcccgcacctttttatttctctgaccattcttttaattgtgaggcggtcatcggaccgacgatctttttttcgatttctcctttttcattcagcagaaatgacgtgggaatcgtcatgacatcgtattccttcataagctcgcctttcgtgtcaagaacaatcgggaatgtgagatggtgctgagtgacaaagttttgaacggtatttttatttcgctcggcattcatcaaatttaccgttacaaggcttacatcatcagactgatgctgttcaaaataggtttggaattgcggcagttcttttttgcacggcggacaccacgatgtccaaaaatgcaaaatcgttttctgccctttattcggaatcgatatttcgtctccttcaatcgtcttcatcagaaacacggcgggaactgcctgtttttctgatgaggcttttgcttcaggcatccaaacggcggcagctatcaaaaggactgcacatacaattagacggtttttatgcatatgatcttcctttcacgcgtttcggatagcttgcccttccttattgaaatgtatcagccttttcagctttcgatccggggagctgttcttccgccgcccgtcaaaaacacggagacaccgaggtctttgcagatcgtcacgtaatgtaaacttgtcagaagaatcatgccggtattcataccgagtataatgccgagcatttgcaattccggcatagaaccgagcacatacatcattgaaagacctacaatgctgctccatacgttatgataaaacgccgttttcacgtggccgatgccgatcagacaggcttgaagcggcatcacaaacagatgaaaaagaaaaaacggccacaaaagctgcaaataatactgcgcttccggagactgaaaaaacaaatgggtcagcgggcccgcgaactgaaacatgacccagaccgccggaatgccgtagccgaatgtaataaaaatcgcttgtctcagccgtttcagcacaatatcatattgggacagcgcatacgcttctgaaatgctgggaatcataacgaccatcagcgaatgggcgataaatgcgggaaacgaaccgattgtcatcgctacaccggcaagcattccgtattgatcaatcgcggcggtcccggctgccccggacgccagcagcgctcctttaaccaagaagggttcaattgcgtttgtcaccgcatgaaatatacgaagtcccgttgtcgggatggatacggccaggaggcgtttccgcacgtctttcccgcgaagatgaatgtgctgatggccggaaagcgccctccgcgccaaaataaactgcgtatacagataaacgaacaccacaacatcgcttgcgaccagcacaaataacgaaataagcacggccatatcaatttcaaaagagtaccattgaaaaaagataaacagacaaagcacttgaatgatttttttcaagacattcgcaaccgcgatttttcccatttgctgcacacccataaaataacctctggcgatggatgtaaaagcgacgactggaatcagcccgatgacaatccctttaataaacgggtgatacgtatcgaatacaggaatgaacggcagcgcgatgcttgcggccgcggttgaaaacgcggtaaaaacggcggtcattctgaaggcatgccgaagcatgctttcatgcagcttctgattggattccgcgatgaattttgaaatagagatcggaagctccagactggcgatcacgataattaaaaaaatggtgggcagaatgctcatgtaaagccccatcccatgctcgccaagctcccgcgccagtatcatattcacgacaaattccagacattccgcgaaaaaggcggcgatggataaaagaatgatccctttcacaaatcgattcatggtgtctctccttgtctcacgttcttccatcatcatatgagacaagttctgaaaatattttcgatttctcaaaattgaaaaaagcatagcggggatattttttatcccgctatgcttcttacatcgcaaatacgtgtctgccgatccgttcgataatttttcgggaacggatccagtggtcagatgccgttttcggattgtagaaaaacaacgcgttcgtttctctgcccggatggtctagcgcctcatttgcggcggcgatggaatccttatccggcttttgattaatgcttccgtttgctaccggttcaaatgcattcctttgatagatcacgccccgaatggtatccgggaaaccgtttttttcagtacggttcagcactacgctggctaccgcaaccttccctttataagattcacctttcgcttctgcgtgaacgagacgtgacaggagctgtctgtcagcgcgggaatacgtttttttcggcggctgataagccgtctcgtccggttttgctttcttctcttggtgagatgacagctttatcggttggatagagtgcttatgatccgtttctgagagcttcggaaccgggctttttttatttaaatcagcaaccagtgtgctgggttcttgctttggcttcttcgcaaaagtaaacagagcttctgtatgttcaatttttgatgcaggcataaaacatagaaaaaagacagccaaggcagcaaattttgtcgtcatacgatttcctccttaaatacttcactaccttaacaagagctgtacgcaaattcacggttaaagattttccaatgctcccaatcagcttttatgatggaagaagtttgttaacagccttgttattggcaggaaaacagccgtcattttcacaacattaaccaaatagcagtaaaagtatccatcggagggattttacattttgtttacatctgttacagccagatgaaataagcagcgaaaacaaaaaaagactcctcaagtgcgaggagccgtcagcttcttggctgttctaaatactggaagataacatctccgccctgctgggcaataccgcggaaatgcttaaaatcttcctgcttcgacaaaaccgctcgaaatgcaagaaaatgttctttctgcaccctgaattctttgatttcaccgatgcgcatttggttgatacgttctgaaatttcctcaggcagcaacgaatacagcctccttttctcggctttttcccgaaaaacaatataccatctttcccccgccgggacaatgattgagcgggctgatacccatatcgctttacttcttaaagaaaatactgcaaaatattttcaaacaggatttatgataaaggagaggaagctcgtgaaaattgctaaggttggaaacgtcattgaatttaaaaacggattaaccggtattgttgaaaaagtaaatgaaaactccgtcatcgttgatgtaaccatcatggataattatcgtgaccttgaattagattccctcactgtcgtcaaccataagaattataaaatcatcagagactcctattaaaccccccgaacaatccgaaccatttacatatcccgcacaaaagctgccgcccggcagctttttcaaatgaattcagatctcggtcatttccacaaaaaaatcatcggtctcatctttattgtaaagatttgtgacggatgtatagtagttggttattttaccgcggaattcaagcccacgctcgggcgccttgatgtcaaatgttttttcatacaaaaggacggcaatatcatgatacgtttcagaggtcaccttcaatacgaatgaaatcatacggccgtttttacccgcactttctttacaatcatacattttcagccttacaccgtttaactctaacggctccataacgaacactccttctttttacaggacatgctaccatgctggccattcctttacaattgatccgctccgaataagaaaaaacagcgcagtcctttacaaacatacgttccctattttataatgaaacagacgagctgccatccagcacccgtcacgtattgaagcggcgagtacactccccccgggtttactcgtctttttcttttctccaaatgatctctcttttccttatagaagttctgtgcaaatatcatgcacctttttggctgcgtggcagagacgaaaaatacccccgcttaaaaggcggggtatttaggttatagtccgagtccgtactccgtctgaaattaacgattatcaatcgtctccggatacatatcatgattcatcatccgatgttcggccattttttcgtattttgttcccggtctgccgtagtttgtatacgggtcaatggagattccgcctcttggcgtgaatttgccccatacttcaatgtagcgggggtccattaattcgatcaagtcattcatgatgatgttcatgcagtcctcgtggaaatctccgtggttgcggaagctgaaaagatacagctttaacgatttgctttccaccattttttcatccggaatatagctgatgtagatggttgcaaaatccggctgtcccgttttcgggcaaagcgacgtaaattccgggcagttgaatttaacgaaataatcacggttcacgtgtttattcggaaatgattccaaaacctccggcgcatattcaaataaatagtttgtcccttgattccccaggagcgtaactccttctaattctgattcttttcttgtcatataaatctccctttctattaaactccccgtttattgccccaaagcagcgtatgcagctgaggcaggactctgacgagattcagatccgaatcggctgaaaccttatcaacgagtgtttcgtattttccgagcagatgtgcgatcaatgcccggtcgtccgtcgtatggacgttatcgtttccgacctgaagataaaacgggatattcggataccgcttgtgcacggttttcgcgaattgcagatcttcatcattaaaaatgacgacctttaagctgaccgcgttaagcctttctgccgcatcaagcgaagacataatatgatcgagctttgcaaaatcggttgtcatccccgaacttggcggcttcggtgaaatcgtcaggtcgttaatcattgtgaaccaatcctgatagactgttccctgcgtttctaaagcggcgcgcaccccgtgctctttcagcagcagaatcagcgcgtcaagctgctttaacagcgccgggtttcctcctgagatggtgacatgagaaaaggcgtctccgccgatttctctcagctcgcggtaaatgtcttccgccgtcatccagcggatatcttttttggctgatccgtcccatgtaaaagcggagtcgcaccagctgcaggagtagtcacagcccgccgtgcggacgaacatggttttctggccgataaccatgccctccccttgtatcgtcggtccgaaaatttctaataccggaattcctttagccattcctatcaccttttttcgggcggtatacgcaatagcttgtcggggtttccctgacaaaaacctgcacgcagaccggctgattctccagtgtttcgaggtaggactgcaccttatcataaatcgttttggctacgacctcggtcgtcggcagtgaatatctgtcatcatcagaaaattcctcatggtcattcagcaatgtatggtcataagcgccgtgcaccaatttcttcagcacgctgaaattcacgagaaagcctgaatcgtccagttcatcccccgcaactgtaatatttactgtatacgtgtgcccgtggactctgctgcacgctccggcgctttcgcggggaataaagtgcgcggctgaaatgtgcatgtccttattcaactcaaacgaataaggatgctgaacctgcgggtaaatttgagaaagcaattagttccgctctcctttcattttcatatattcatcatatcctttattgcggagcaggcatgccgggcattcgccgcatccgtccgcaatgatgccgttatagcaagtcagtgtgttattctttacaaaatcaagcgcgccgagctcatccgcaagtttccacgtttctgctttgttcagccacataaggggcgtatgaatgacgaacggcttttccatcgccaagttgacggtgacgttgcaggatttgacaaactcgtcacggcagtccgggtagccgctgaaatcagtctcgcaaacaccggtaataatgtggcgcgcgccgatttgatatgcaagaatcgatgcaaaggataaaaatacaaggttgcgtcccggtacaaaggttgtcggcaattccccgtccttcgcttcaatttcgatatcatctcttgtcagcgcattcggcgcaagctgatttaaaagagacatatcaagcaagtggtttttgacaccgagcttttcggcaatcgattttgccacatcgatttcttcttggtgacgctgattataatggaatgtaacggtttccacttcttcaaagttttgcaaagcccataataaacaagtcgtgctgtcttggcctccgctgaacaccacaaccgctttttcttttttcatgtctttctctcccttatctatcattccataaaaaaagcgcctttttcggagaaggcgccctaaaaaacataaaaaaaccgtatccaaggatacagctcgtccttagttttttatagagggtgtagctagaacctctcccgcatcaatacggattttcttcttttttcacttttgctatcataccataatgttgtttcccgtgacaataaaaaaacagcctgaaccctgtgtcaggctgcaaaagcgggtttaagccccgcgtttcttccccggaaatgccatcagcgcaatcccgatcagaacaaataaagcaggccagaaaacagaaaccggaatgatcggctgatacgtcatcataaagcaaagtgctgtcaaggtcagcactgcaaccggaatgagcagcgccttctgtttcccgccgaacagccacagctcaaataaaccgaatgccgttgccaacaggtaaacaggccatgtcacatcggagtagaaccaattggttgccgtttcaaagacaaacaagatccccgtgatcaataagatgccgcccggtacgagaagccccgcgtttttgacaggtttcgggccgaaaatcggaatgtgaaaagcggcgcccagcaacagaatgagagcgggccagccgcgttcgctgatgacttcatttgcattggtgaatatgccgaaaatgcccgcggcgcacagaaccgccgcagcagtcaaaagccctctttgccttctgccgaacagccaggcttcaaacagcccgaatgcaacggcaaagaggtaaacaggcgatgtcatcgttgcgtatgtccaatccgtcagcgtttcaaaccataacaagccgcccgtcacaagcaaaatgccgcccggaataagaaggcccgatctttttttcggttgcataaaggcagcggcgtgaaacaaaagcgcggctgcgatgatcaaaagcggccacagccccgtcatcagcataccggcaaagcatagtgctcccgcggctgtcaggataaaagcaggaatcaatacgccgatctttctcccgccgaaataccacagctcaaacagaccgagagcaggcgcccatatataaacaggccacgtcatgcctgaatacgtccatcccgttgcggtctcaaaacaaaacaggcagcccagcacaagaaacataccgccgggaacgagcagtcccgcctgttcaggcgtttttttcgcaaaaataaatccggcgtgaaaccctgcggacattataatgaaaagaaacggccacgccgaacctgcggatatatgtataactcccgccttctgtaaaaaaaacgtaatgccgatacaaataaaaataaatcccaataatacacgtcgatccttcatctcttactcctccccatcatttcccaattcattatacagaaatggcaggaaaaaagaagggaattcccaaaatatacagacattttccttatttttctttcgggatttttttgcaaatcaatgcgcccataaaagcgaggctcacatacccaaacaccggataaacggtggaaatcagctgtccgtaaccgatttggctgataatgaaagcaaacgccaaaatgccgccgtaaatatatgtactttttatatgaagaaaactgtttaattgtttttccaatccgtataaattgccgataaccgacgtaaacacttccccgaaaataataaacaaataaatgatatgaagcgaacgcgaatacgaatagacaacttgagccatcggaatgtcaaactccagcacatccggcagcaccgataatgataaaaagctcgcggcaagcaccagtgtcaacagaacgccgcctatataagctccccttctgatcaccttctctgaagacatttcgttcgcaagcggcacaaggacggcttgggcgagcgataaatttaacgcgccgtaagagacggcggacaaaagccagttccacttgtcaggccatacccattcgtccgcgtttctcgtgcttgtaaatacaaatgaatcagctgtcacgataaaagagaaagaaattaaaagcggcaccaccaatatattgacgccgaacacacctttaacaccgcttgtcatgacggcaaaactcagtacgatcgtcagtaggatccccgcttgtgcgggccagccaagctgttcatgaaacagcgctccggctccggacagcatgacagaggtcactcccagcaatataaacatcataaacatgttcacggcgcggccgatggactggccgaataaatatgtgttcaattcctgataagatgctgcatgaatccgtttggaaataatcatgattttggcgcctaaatatgtaaacatcagaccgcttaccacgataccgaacagaccgatccagccaaacttcagaaaaaactcaacgatttcccgtcccgtggcaaaaccggctcctacaaccgtgcctacgtatacaaatgcaagctgacttgcagaaccttttgtttgtcccatttcaccctccggctaaacgcagatttgtccaggcctttatatatgcttatgagacaagtctcccgaaaagacgaacaaatcgtccttccccggaaaaaacagattcagctctctcctctaagcaaaaatattgaaagaaaaaaagggccggcgtatactcttcatcaagaaaggtcaaagcatttcatttcctttccgactatattggtcaaaaataatcaaacctcacgaatatcacttatcatgctgtaaacatttatttttcggggtttgaaacaaaatacttgaaagtcaaagaaggtcagagtatactaataatcaaagaaggtcaaagtttcgaccttattttctaacccatttggtcaaagatgatcaaatatttttcgaggaggttttggcaaatgcgttgtcaacattgtcagaaaaacgaggcgacgattcgcctgaacatgcaagtcaattccattcaaaaacaattcgttttatgtgaaacatgttatacagaattaacccgaaaaccgtctatgagcatggggccgcaatcattcggattcccgtttgagcaaggtttcgctcccaatcaaaataaacagcaggccggccctgaaaaaggcctgcttgacgagctcgctcaaaacgtcacaaacggcgcaaaagcaggtctgattgaccctgtgatcggccgcgataatgaagtggcgcgcgtaattgaaattttgaaccgccggaataaaaacaatccggtgctgatcggtgagccgggcgtcggtaaaacggctattgcagaaggcctcgcgcttaaaatcgctgaaggcgatgtgccgaacaagttgaaaaacaaagagctttacctgcttgacgtcgcttctctcgtcgccaatacagggatcagaggccagtttgaagaaagaatgaaacaattaatgaacgaattaaaagaacggaaaaatgtcatcttgttcattgatgagattcaccttcttgtaggtgccggctctgccgagggatcaatggatgccgggaacatcctgaaaccggcgcttgccagaggcgagctgcaggtcatcggggcgacaacgctgaaagagtaccgccagattgaaaaagatgcggcgcttgaaagacgcttccagcctgtcatggttcacgagcctacaatagaacaagccatcagcattctggaaggcattaaagataaatacgagaaataccacggcgtcacattcagcaatgaagcgataaacgcctgtgttacgctttcatcccgttacattcaggaccgccacctgccggataaagcgatcgacttattagatgaagccggctctaaggcgaacctggaacttgataccgtaaatgaagaagatgcggctgagagactcaatgcaattgacgcggagaaaacaaaagcgcttcaggaagaaaattatgagcttgccgcgaaactgcgtgatgaagaagcagctttggaaaagcagctggcgcatgaaacaccggcctcttcacctgaaatcggcgcggagcatattcaagccatcattgaacaaaaaacaggcattccggtcggaaaactccaggctgatgaacaagtcaaaatgaaggaacttgaagagcatcttcatcagcgtgtcatcggtcaggaaaaagccgtgaaaaaagtggcgaaagcagtcagacgaagccgcgccggtttaaaatccaaaaacagacctgtcggctccttcctctttgtcggaccgaccggagtcggaaaaaccgagttatcaaagacactcgcagatgaactgttcggtacaaaagattccattatccgtctcgatatgagtgaatacatggaaaaacacgccgtatcaaaaattatcggttcaccgccgggatatgtcggacacgatgaagccggtcaattaacggaaaaagtgcgccgcaatccgtacagcatcgtgctgctcgatgagattgaaaaagcccaccctgatgtccagcatatgtttctgcagattatggaggacggccgtctgacagacagccagggcagaacggtcagctttaaagataccgttttgattatgacaagcaacgctggaaccggcgaaaaacaggtgaaagtcggattccaatctgaagagagcgtcatggaagaacaaacgctgattgattcactgagcgcgttcttcaaaccggagtttttaaaccggtttgacagcattattgaattccaatccctgaaaaaagaacatctcgtgaaaatcgtcagcctgcttctcacagagcttgaagacacattaaaagagcgcggcatcagcctgagcgtcaccgatgatgcgaaggaaaaaatcgctgaaatcggctaccaccccgctttcggagcacgcccgctcagaagaaccatccaagaattgatcgaggacgaaatgacagatcttctattggatgacaacgaaatcaaagccttccatgtcgtaatggaagaggacggcatcaaagtccgggcacaataagaaaaaagcggttccctcctcgcggggagctgcttttttgtttctttctccatgccggaagggagaaactgtgaagaattcgggaacaatttttcaatcaccctaaagttccatgcactgccaccgatattaaccatagaaagctagtataaaggatttggtgaaaactatggataaaacatcgattatcggtatcatcctcgcagtgattgctttaagcgtgggcatggtgctgaaaggggtcagcttaagcgcactcgctaacccggcagctattctgattattttgttcggtacgatttctgcggtgatcatcgcattccccggaaaagaaatcaaaaaagtgcctgccctttttaaagtgctgtttaaagaaaacaaacagctgacaattgcgcaactaattcctatgttctctcaatgggcgcaaatcgccagacgtgaaggtctgctcgcattggaagcaagcattgaagacgtggatgacgcatttttaaaaaacggcctgagcatggcggttgacggacaaagcgcagaatttatcagagatattatgactgaagaagttgaagcgatggaagacagacaccaggccggcgcagccatctttacacaagccggcacatatgcgccgacactcggcgttttgggtgcggtcatcggccttatcgccgctctttccaacatgaacaataccgaggcgctcggacatgccatcagtgcggcgtttgtcgccacccttctcgggattttcacaggatatgtactatggcatcccttcgccaacaaactgaaacgcaaatcaaagcaggaagtcaaactgcgtgaaatcatgatcgaaggcgttctgtcagtgcttgaaggacaggccccgaaagtgatcgaacaaaaacttctcatgtatcttcctgcgaatgaacgcgcaaaagtcgctgaacaagaaggagaggcaaacaatggcgagaaaaaagaagaagaagcatgatgacgagcatgtggatgagtcttggctgatcccgtacgcggatttgctcacccttcttttggctctgttcattgtattgttcgccatgagctcggtcgatgcggcgaaattccaaatgctgtctaaatcatttaacgccgtgtttaccggaggcacgggtgttcttgaatattcaagcgtcacccctcctgaaaacgaaaaagacggcgttgatcagttaaaaaaagacaaggaaaaagataaagaacagaaaaagaaagaaagagaagcagccgaccgcgaagaacttgaaggcgtgcaaaagcaagtcaatcaatttataaaaaacaaaaagcttgaaactcagctggaaacaaagctgactaaagaaggactcttaattaccattaaagacagtatcttttttgattccggacgggcggacatccgtcaggaagatattccgcttgccaaggaaatctcgaatctccttgtgctgaatccgccgaggaatattatcatcagcggacatacggacaatgtgccgattaaaaactcacaatatcaatctaactggcatttaagcgtcatgcgggccgtcaacttcatggctattctcacggaaaacccgaaacttgacgcaaaagtattcagcgccaaaggtttcggagagtataaaccggccgtgtcgaacaaaaccgctgaagggcgcagcaaaaacaggcgcgtcgaggtattgatacagcctagaaacgccgcgactgaccaaaatcagtaatataaaaaaggaagcctttcaaacggcttccttttttatttctgatgaaaatgtttagcgtttaaccccactcttttcagcatttccgtacacatttctatctcttcatcactcagcacactgatcatttctttaatttcttcagcatgatcagggaaaatatcgtccaaaagacggattcccttttcggaaatttgtgcgaaagtcactcttctgtcagtcggcgaggcttttctgatgagaagttcttttttctctaatttgtcaacaacatatgtaatacttccgctcgctaataaaattttgtcgccgatctgctgaagcggctggttgcctttgtggtacagcagctcaagcaccgcaaattccgtcgggttcagaccgtgcttatgaatatgtttattcatatggtcgttaatagatcggtacgcacgtgacagtacaataaataatttcaatgagttttctgttttatccgtcatacattcaatcatccttttacaaaagaaaccgttacagagaaacattaataaacaaaatgaaaaatgtcaacaaaaatgtttccaaaatttctcttctttttgtctggccttaataaaataatttgtttttctatcattttggttattttttcttattaaagaagtataaaaatgatataatacctctattcaagtgtaatgttggagcgatgcagagtgaatacatttaaaggtgcccggggaaagatcaaactttatctcatattggtgatcatcccggcacttattatcagctttttcatttatgaaaaagaaaagcagaaaatagccgataaacacatacaggaagccagtatgatgctcaaccttcaccgcaataagctcaattatttaatcggtgaaacaaaagcccggatgacaacacttgcgatcgctgtcgataagcctgtcaatgaagaaaagatcattgatattctcgatcaggcttttgaggatgaacccagattcagcggtctgtatatgctgaattccaaaggtgatgtcatcgcaagcacgactgatctgaaatcaaaggtgaatttggccgaccgaccgtattttacgaaggcgaaaaagacgaaaaaaacggttatcacaaatgactactccagcagaattacaggccagcgcatcttcacgatctgcgtgccggtgttagacgcaaaacgggaagtcacggattatttagtagccgccattcaagtcgattatttgagaaatatgatcaatatgctgagccctgacgtttatgtcaaggcaaccaatcagaataaagtgatatttgccagcggacgggctgatcaatcagaaggggtgaaaccggtcagcggctatctggatgatattaattggaatatcaatgtttatccgaaaccggttgagctgaacgagctgaccaaaagcgtactgctgccgatgtccagtattgccgtgctgctgaatattctgttcatcctcgtccaatattatctgcttaagcgcaagacccagctggagcgcgctcaaaatgaagcgcagaaattggagctgatcggaacgcttgccgccagcaccgcccatgaaatccgcaacccgcttacagggatcagcggcttcattcagcttttgcagaaaaaatacaaatcggaggaagatcagctgtatttctcaattattgagcaggagattaaacggatcaatcagattgtcagtgagtttttagtgctcggtaaacccactgctgaacggttggaagtgaactcgctgcaggatattcttgatgagattatgccgattatttattctgaagggaatctgtataatgtggaagtgaatgtggagattctcgtcaatcggccgctcaaggtcaactgcacgaaagaccatattaaacaggtgattttaaatgtcgcaaaaaacgcgctggaatccatgcaggaaggcggccggctgtccatctatttagaagcccgcgaccataaagcagtcattaaggtggccgacaacggaatgggcatttctgaagatatgcttgaacacatttttcttccgtttgtaacgtcaaaggaaaaaggcaccggcctcggccttgtcgtatgtaaacgaatcatgctgatgtacggcggttcgattgacattcaaagcgaagtcgataagggcacagaggtcaccattacccttcctgccgcttcacgatgaaaaaaacaccctgggtcggggtgttttttatttaaagaagaatatgtgtaagaggatataccagaggaacggcatcatagccggcagatagtacgaggcgcttcgtgagccgtgccagcggaaaaatctgctgactgtacgcggtcatctttcggatgcggcgcttgatcaggaagcgcattcagtcttcgttatctgttttatcatcaatcatttgtttgcttcatatgcaggcatgacgtcaccgcgggagaacaagcctattttcttcacaaggccctgtattccttggtgatgtgtgcgatcacggtttaccagctgctgatacgcgttcatcagacagtccagttcctggctgtgcctgatcgtgtcatatccggtaaacccttgtctgttagccgcatctatcatcatttttctttttttatcaatagatacaagcaatttttcttgttcagaataactgcccattcacttcacccctcaccgctaaaagaataggaaacaagtttgattgggttattgagcattattacagattatactttatttgtaaacatttttttactaaataacttattttttcatttcatattggaatctttagcatgaatacgagaataatacccattcaggtaatgatataaacagaatgcggcatattcaagatttaaaaaacagccacagctgactttatattacaataaaaaacctctcataccggcgggggcatgagaggttcgggcgtctatcagttttgcacactttcattttcgtaaatcggcacccagccctcagtcgtcacgaaaattcggattgcgacgacccggcggtcttcctgaagcgtaaagtagtggcggatgttctccggaactgaaatcaaatcgcccggatttaaacggacgtcgaaaaatgtgccgtctttgccttgaatgacgaagatgccgtgtccgctgacgataaagcggacttcatcatccgtgtggtgatgttctctttggaaattttttaataattcatcaagattcggcgtggtatctgataaagaaatgacatcctgagactgatatccgcgccgggctgaaatgtcctgaatctccgtgtcaaacgccgcgagaatccgttctttttcatcttctgtcagattgtatttctccgaaagctcagacggaagtttttcaatgttccactgctcatagatcacctcttgttcgtctaaaaagcgcgctacttcttcctgattttcaatgagcgtattcttttcgtcatgtattctgatggtcgccattttccgttcctccttttattttacaagctgcggccgcagtgacagaagcttgaggtggcagctgaataaaaattcataggcttccagcacccttttcgcttcaaatgcggtccgcccccatgccgtaatgccgtgattacggattaacaccgcgcctgagccggcgtccgcatggtgcgcgaagttttcggccaatgccgggatgtgcgccgggttgtcaatgatcggaacggtcacggacgcgttttcctcccataatccgagcgccttaatcatctcctgcccctgaaacgtgatttgtttttcatccccgtaaagctctgagatgacattattattaacggtatggacatgcagacagcagccggcttctgtcttttggtataagtaagtatggagaagcgtttccgctgaaggttttaaagaatggccggtctcagcgggcttcccgttctcatcgattaagagaaaatcttcgtctgtttcttttcgtttgtcttttccgctcgccgtaacgaggaaagtcagcggcgcgtcggatactttgatggaaagattcccgctcgttgccgggaaccagtctctttcggccagctcgcgctttacctcggcaagttcgcgccagcgttcttcttttacagccacgcctgcacctccccgatgttttcaatgcctgttttcacctcatgaaaatcttgaaaaggcagatgccggaggccgagttctttgcattcagtcaaaagataatctctcgcaaaacacatatcggataactttgcagcctcaacatccgtgaccgaatcaccgatcataatgagaaatttctgctgatcggacagcttccggatgactgacggtttgcagcagccgcattgattggtgcagcctccgtcacaggcgtgcggccagtctatatgaatatattcattgtcaaaggatgcatgattgcagaaaatccgctccttttctacgatcccttccaaaagcggatgcacaaaaaagtccattcctccgcttacgatataaaacgggaggccgtttgaccggacaaacgagacaaaatccaaaaagccgtcccgtattttcgcatccttcagaataaagtctgtcagttcttcttttaagctgctcggcagcagtccgaacatccggccgactccttcttggattgataggcttttagacagaacaccgtcttttaattcaatccactcagggggcgcgaattctttcatcatgctgacaatgttgtcgttcatggtgaccgttccgtcgaaatcacaaataatcagcggtgtgcgggtcatacggcttccacccttccccatttgtctaatgcgagctgaagatctttgcacgacgcggctttttcttcaatcggctgcgcttcaagcaccgcatcaatgatggcgcggaacgctcttccgccgccctcggctcctttcggatggccgtgaatgcctccgccggcattgatgatgtgatcgatgccgaaatcgcgcatcaacaatggcaccataccgggatgaatgcctgccgacgggacggcaaacgacggatgaaagacatcgtcttttacacattcatcatggattgcaagcgcggactccttcggaagagcaacggatccgtaaggtgacggaaataaactgaaatcagcgccgcaatagcggttcagcttgccgagcaaaagcgcatgcgacaagccgtaaacgggagatgaagtgaacgcgccgctgactgccggatgcgccatgatcggaagcgggatttccctgtcttctgcaaggctctgcatcacatctaaaccgtaagcgaacacattcaataaaagcgcgtccgccccgagttctgccgcgcgcctcgctttatcccgcagttcagcggtccttcccgtaaggtttacggcatacagcgttttatgccccgtctcctcccgggtttccttcaggacttgttttccttcgataatgcgggtttcaaacggagccagttcattttcaaagaaaatttcgtcatctttaatcagatccacgcctccgagcgcctgctgtctgagctgttctttaatgtcggcgagattccgtccgatcacgcctttaaatatgctcatcagaagcggtctttcaaattcgcccagcagtttgcggatgccgtatataccgaatttcggcccgggaagggagcgtttaaacccttcggaaaattcaagatcagtcaattttatttttccgtccaatgacagctttccgaataccgtcgtcaggacggccggaatatctcttgaaaagttcgcctcgggataggcgatagtgatgacggattgtgtttcgttttctgaggttccttctttctcctcaacttttacgacccggcctttatgttttctgagctgttcctgcttcaccaggggcaggtcagtccaggagcctaccgtcagccccgccgcaatctgttccgcccgcttttcactgtccgttgtgtctgtcagaagatatgttgccaatacttcgctcatgcgtgaacgcctctctttctttcacaaaacataaaaaaacctcttccgtatgagcagaaagaggcttcgtgttatgtccgaatcttatctctcagctcctgctgcaagaattagcaccgtgctttatcagtcggttgccgggcttcatcgggctcgtccctctgcctgctcttgataagaataatgattttataaagtattttgaattatcgcattgttatccagatatgtcaatgctttttcgggtgaaaagattcagtttcccgatccgttccgcagcttctttaagtctttcttcacttgtcagaagaccgactcttatatagccttccccccattttccgaacccgtttccggcagcgacggcgacatccgctttctcgagcagcagatctgaaaacgactgtgacgtataaccgtcgggcacagggagccatgcaaaaaaggagccagccggagccgtcacatcccagccgataccgcggcaggcttcaatccatgcattgcgcctcgattcatatctgtcattttgcgctgcgacgcatgcctgatcctctaaaagagcggctgccgccgcctgctgcgccgcgggaaacaggctgacaaacatatgatcctgataaagattgatcgcttcgatgacagaagcgtttccgacggcaaatccgacccgccagcccgccatattatacgttttggacaaggtatagacttcgattcccgtctcctttgcgccttccgtctgcaaaaagctcagcggtttatgcccgtcaaagccgacggctccgtacgcgaaatcgtgaacgacacaaataccgttttgttccgcaaaaccgaccgtctcctcaaaaaacgcctctgtcgccacagcgccggtcggattattcggataattgagatacagcagcttcgcctcgctccgcaccttttcaggaattacgctgtaatcagggagaaaccctctttcttccgtcagcggcatcatttccattttcgctttcgcaagggcgacgcccgaccagtaatcaggatatccgggatcaggcaccagaatggtatctcccgggtttaaaagacattgcggaagctcaacaagtcccgccttgcctccgaacagcacggcgacttccgtgtccggatcaagcgtgaccccgtactccctttcataaaatgcagcggctgcttttttgaagctgtaagcgccccggaatgatgagtatttatgattttccggcctttcgacggcgcgcttcatttcttcaacgatatgctgaggcgtcggctgatcagggtttccctgccctaaattgatgacgtctctgccttctttcagcttttgatttactttttgcaccaatgatgcgaaaaattgttccggcagctgtttgagtacatctgagatttcaaagttcatatttttcaccttctaaaaatgtcttgaaatgatagtccatcatcatatatggttaaataaaaaaagtaaagagaaacttgaggtgttaaaaaatgaaatggaccgtttcctgtttgcaatttgatatttcatacggaaatccttcagaaaattttaaaaaagcggaatctttgattgagcaagaaagccgccatgcggatgtaatcgtgcttcctgagttgtggacgaccggctatgatctcacacggctagaccagctggcggatgaaaacggcaaagtttcggaacaatggcttaaagaaacggcaaaaacatacaacgtacacctcgttgccggatcttttgcggtcaaagaaggcgaaaatgtctataacaccatgtacatcgccgataacagcggacagatcgtgaagcggtatcagaaagcccatctgtttcagctgatggatgaacacctttacttgtcagcgggaaacagcgacggttcctttgagctcgacggtgtcaagtgcgccgggctgatctgctatgatatccgtttccccgaatggatcagaaagcatacgtcccagggcgcgaatgtcctgtttatctctgcggaatggcctctgccccgccttgatcattggcgaagcctgcttatcgccagagcaattgaaaaccaatgttttgtcgcagcctctaactgcacggggtccaatcccgataatgaatttgccggccacagcctgattattgacccgtggggccggattttagccgaaggagaccggacggaaggcgcagtccgggcggaaatcgatgtgtcagaaagcgcggccgtccgcggaaccattccggttttccaagacttgcggcgtgatttatattaattttcaaaaaaatgttgacaagaatatccggcacctgctaatattttcatcaactgattaatccgaattgtgatacaaatcaatatattttctcttatcgagagttgggcgagggaattggccttttgaccccaacagcaaccgaccgtaattccattgtgaaatggggcgcgtacattttgcgccgagacgattgtctcataaggcacggtgctaattccatcagatgttatctgagagataagaggcggactgcactgtttcagcctccttctctttcagagaaggaggctttttttcgggcgtattctccgtcacgatctcttactgccactacataattggagggtaaatccatgtcagcaactaaaacaagtctttatgaacaattaacagaaagctccgccgccgcgttagccgtcaagctcggcttattccaaagcaaaagcactctgacatgccgtgaaatcggcgacggcaatttaaattacgtctttcatgtttacgataaagaaaaccaaaaaggactgattatcaaacaggcgattccttacgcgaaagtcgtcggtgaaagctggccgcttacaattgatcgggcgagaatcgaaagcagcgccctcatccgccagggcgaacacgtgccgcacctcgttccggccgtttactattccgatactgaaatggccgtcacggtaatggaagacctctcacatttgcagatttcaagaaaagggctgctggaagggcagcattatccgaacttatcggttcatatcggtgaatttttagggaaaacgcttttttactcatccgattatgcgcttgatgcgaaagtaaagcagcagctcgcaaagcagtttacaaatcctgagctttgcaatattacagaaaggcttgtgtttacagaaccgtttctcgaccatgagaccaacgattttgaagaggagctgcgcccgtacgcagaaaaagtttggaacaattcccggctgaaagaaggcgctgacgaattgaaagccatctttctgaattccgcggaaacattggttcacggcgatctgcacacgggaagcatcttcgccgatgaacatgaaacaaaggtgattgatcccgagtttgctttcttcggaccgatcgggtttgacatcggccaatttatcgccaatctgctgttaaacgccctcagccgcgacggtgacgacagacagccgttatatgaccatactgccgccgtatgggatacatttgtgaaaacattcagtgaagcatgggagaaagactgcctgccttcccacagacacctgctggaagacacactgaaaaacgcgtttgaggaagcggtcggttttgcgggatgcgaattgatccggcgcacgatcggactcgcccatgtggctgacttagatgaaatcactccgtttgacaaacgaatcgaacggaagaagctggcgcttgagatcggcgcctattatatcgaaaacagaaaagaactgaagcatatcaccgaagttctggaccaatttaagctccgtgtaaaggaatgatgcagcatgaccaatgaatttgccatcccccgttccgtggaatggaaagaaacctacatccgcattttaaatcagcaaaaacttcccgacgtcactgagtatgtggaacttgaaacaaaggaagatgtattcgacgcgattgtcacgctgaaagtaaggggcgccccggccatcggtataaccgcggcattcggactcgcgctctccgccaagtcatttgaagcccgcgacctttcagatttccgacgtcagttcgcggatgtcaaagcgtatttaaacagttcgaggcccactgccgtcaacctcgcgtgggcgcttgacagactgacggattccatcagggatgcaatctcaatcaatgaagcgaaaacaacgctcgttcatgaagctattcaaattcagattgaggatgaagaaacctgccgaatgatcggccaaaatgcgctgcacctttttaaaaaaggcgaccagatcatgaccatctgcaatgcgggctcgattgctacaagccggtacggtacggcgcttgctcccttttacttagcgaaacaaaaagacctcggccttcatatctacgcatgtgaaacaagacccgttctccagggatcccggctgacggcgtgggagctgatgcagggcggaattgatgtcacactcattacggacagcatggccgcccatacaatgaaggaaaaacatatatcagcagtcattgtcggcgctgacagaattgctaaaaacggagatacggccaacaaaatcggaacttacggcctcgctattttggcaaacgcctttcagattccgttttttgtggccgcaccgctttcgacctttgacttgcagattgaaaacggcgatcagattccgattgaagaaagagatccggatgaagtcagacagatctcaggcatacgcaccgctcccgaagatgtgccggtcttcaatccggcctttgacatcacaccgggcagcctgatttcaggcattatcaccgagaaaggaattgtgaccggttcttacacggaagaaattgaacaattattcgcagactgtcagctgagctgaaaaaccgctgatgatgttgcctcgggcaatgtcagcggtttttttgtctgcacaatgtaatcacttcatctttttgggcggctgtaatgagatgcattttaaaaaacagctctgcataaccggctatcttttgcggacggctcattttcatcaggcttcgtcctcctttttcaccagaccaacttttttcacttaataaaatgatatgtcggacgcaaaaaaacggaacgtgccatatgttttatttttctttataggatatttgttcgatgttcagcagcaccgcttttacatccgtcttcgtgcccgcgtatcccgttaaggcgctgtttttgccgattacccgatggcacgggacaaaaatcggcagccggtttcgtttattggcttgtccgatggcgcgcaccgctttcggttttccgatcgcttcggccatatcgccgtagcttcgggattccccgtaaggaatcatcgtcagcgcgttccataccctttcctgaaagggtgtgcctttttgtctcaaaggcagagagaattgctttctttctcctgaaaaataggatgccagctgctgtttcgcctccgacagcaaagcggtttcgcacggctttacgccgggcgcgtctttccgccattcctcaaaatcttccccggtgagaaacaggccggtaataaagccctcttcctctgttacgataacggttccaaacggcgcttttacacttgtaaaacagatcattccccgctccttctttcttcggtattctgccggatcggaagcgtcaaatgaaaaaccgtgcccttcccttcttcactttccacatgaatgcgtccctgatgttcttcgatgattttatagctgaccatcagaccgaggcccgttcccctgtcttttgtcgtgtaaaatggctcgcccagacgttttaatttgtcttcggaaatgcctgttccttcatcttgaaaagaaatcaaaatgtggtcttgatcagaaggctggatggtcacgtagatattgccgccgcccggcatgacttcaatggcgttttttaaaatattgataaacacctgttttaattgattcggttcacagtaaatcggcgggatgtttccggtcaggttcagatgaatctgcacattgacaagattggcctgggcattcaaaagatcagccgtgtctttcagaatctgcgtcacgtctttttcttcatataatatcgcctgaggtttcgctaaaattaaaaattcagtgatgatagactcgatgcgttttaattctgaggtaatgacgttaaagtacagggaatattcgccttcaatgcttccttgaagaagctgaatgaaccctttcagcgctgtcatcgggtttctgatttcgtgggcgatgcccgccgccagctcccctacaacatgaagagtgtcggatttccgcagcctctcttcaagttctttggcctctgtgacatctttaaagatggccagattcatattttgaatgatatttcttttgaaggagaattccagtttgcggctgtcactgctgcttaacaggaaggggatttcattatccattccttctaaatcaatctttctggcgggaacacccgcgttttcaatatcaaataaagaaagaatatccggaacggtgtacgctctcagctcctcatccggcatgccgagtatacggcttgcgagaggattcgcgtcaataatgcggaattggttgtcaaataagaccttgccgtccattgagccgttgaatacttttctgaatttcagctcgctttcccgcaattctttttccatccgcttacgatcgctgacatttcttaaaatggttaaatgctgaccttcaagtatggttcgttttgatgtaaactcaagctctttgtattggccgttcgccatctgaaacagcatttcttcacggatttccccgtatttttcatatttcttcttaatctgcttgtattttttctgcggatcaacgataaacgtacataaattcgtctccagcagcttatccatcggcagttcgaaaatgcggcacgccgattcgtttgctttggcaatctttccgtcatcagaccaaatgacaatcgcgtccatcgcgttttcaaaaatttcgcggaatcgctcttcgcttttaaagagtttcaattccatcaaccgtttctctgttatatctctcataatggacatgtagaacccgctgattaagttggacgtaatcgtaaattcaaacagcttctcttcgccggaccgaagcttgacgggcagttctcctttggcatttccttttctgcggagggtttcccagatttctttcagatgctttttgttttcgccgtcggtaaaatggcggagcgacagatgggacaattcattctggccgatctcaaagcttttgcaaaaagagaggttcgcatcaataaacccgccgtccttatcaaacagcacgatgccgtcgacagccctgtcaaacaaatctttaaacagctgctcgttcatggagaattcgcgctctaatatttttttagaggagatgtccctcatcaccacaaaaaaataatcctccccaattccgtctctggcgaggaattcaatgtatttcgtcgcgccgctgtcaagcttaatcggcacctctttccacagatggcctttttttaaaaactttttcacggccttattcagttcttcctgaggcacggaatataaaaagtccaggacggagcggttaataaggctctctgcctcaatctgcatcatccgggccgcagcctcgttcgcctggacgattttcatttccttacggcatataaaaatggcatcaagcgtgttattcataatcacatgataccggttcaaatcactcttcaggcggtcattttcctctttcatccgcttcagctgctctttcagcgactcgtttgtttgcaaatccagagtttcagccattcagtacactccttcttcaaaaacctatccttcaatatttctacaaaatacctcatcttccttcattcgccctatacatttcagaaaatttcaatgatatgacaagttaaagtctttttctacgatccttacctccccgttacatcatcctaacaatcccttttgtcctccttcaattttttgttttttattttaaaatgaacaccaacaggaaataatcatgcagtggatgatttttgaagagaaggtgatgctatgacaaaatcgcgagacagttactttgacaacgccaagtttatcttgatttttctggtggtgttcggccatatcctccggtcatttattaacggaaatgagtttatgctccatctctacaaattcatttatacttttcatatgccggcctttatcctggtttccggctatttcgcaaaaaactttaagcggaaaggttatgtgaagaagctggctgtgaagctgattattccgtacctgatttttcagggcatttactcggttttttactatttgattcaggatgaaagcatggcaagcgtcaatccgattgatccgcagtggtctctctggtttttagtcagcttattcttttggaatctgctgctttatccctttacgaagctgccgaaaatgtgggcgcttggggcgagctgcgggcttgccgtcatgatcgggtatctcgatttcatcagcagcacgctgagtctttcacggacgtttgtctttcttccgatgtttctcgtcgggttttatttaaagaaacggcactttgatttgcttcgggctaaaagaggcaggcagattgccgcgggcgtactggggattgttttcctcttatgctggtgcattgattttgattactcgtggctgttcggatcggagccttattctacattcggcacagtgtcgctgttgagcggtctgtcgcgcatcggctggtatgttttggcctttgccgccactttcagctttttggcgctcgttccgcaaaagcgttatttctttacgaaatggggtacgagaacgttttacgtgtatctgctgcatggattcattataaaaacgctgcggcagatcgggcttgaagatcacttgtctgattatcagaatttagtcatgctcttaatgttaacggccgctcttacgtccattctctccagcaatgcggtgaaaacggccgcacagccgtttattgagctgcggataaccggcttgcttcaagcggtgaaaggaacaagaaacggtgcttattcgaaataatgcaaaatacctcttaagcgttgccgcttaagaggtattttttattttttgccgtcttcttttttcttcggcttcgtctgttcaagcgtttcaatccattttccggcgttataatcaccgagctcgcttgaaaactcttcttcaagcaatttagggtccatcggctttttatggttttgcatgtctttgctgtggcggttttttttcgtcatattactcgcctccttgtttgccgtgttttgatttgcggtttgcgcctctcagtccgggatcaccgtcatattgtgttttgtatgcatctttgtccatgctctcagtcggtgtattgttgttggtcaaagcttcattctttgctgctttgcgtttcatttgatttcctccttctgtcagcaaatctgttttgaattcattaagcattttttttaagtcgcgcactgtcacgtttttggcctcatcaatgagttcatagccgatctgtccgttcggctcaagcagcacatatttaaaatcttgaatgtctccgaggccttcctgcctgatcctcattgacagctggtcttcggtaaaacgcattttttttaagttttccgggatgatttttccgtttctgacaacggcgacggtttttcctgaaaatagaaactcaaaaaagcttgatttgatttctaaatattccatcagaatcagtaccgcaataaaaatcgccgccgcgaaaatggtttcccataaattatgttcaataaacggctgaataataatcgagccgatcgaaatcatgatgactgtctgggtcaccgacagctggctgatggatttccgtccggcaatccgcaataaaaaggtaccgaccgcgatcataactaccgacttccaaaatacggcaaacaatgacgtcacctctttacaagtagaatctccaaagaaactgtttccactcatccattttacggcaataaaaaaacaccgctttctgaaaagcggtgtcagccgataatcatcctttccttcggataatgataatttgcttcgatttcttttcggccgatcaaataaaggaaagtcaaaatgccgatccggccgataaacatcacaatcatgatcacacattttccgatatcgcttaaatgcggagtaatcccgagcgacaggccggtcgttccgaaagcggaacacacttcaaaaagcagtccgaggagcgtctgatttgtctccgtcacggaaagaatcagcgtcgacccgaacacgagcagaatcgccatcatcgtaacgaccagcgacttcatgacatcagcctgatgaagctcgcgtttaaagaccttgaccgctttattccctctggcaaaatgaaacagagcaagaaggttaagcgcaaacgtcgtcgtacggattccgccgccgaccgagctcggtgatgcgccgataaacatgagggcgcagatgaaaaataatgtcggcgccgacagctggctgatatcaattgtcgcaagcccgccgcttcgcgtagcagttgattgaaagagacataaaaataaaacatcatgccagcttttccccttcataacatggcttgcttcaagcgcgtaaatgcccacggctccgaacaaaacgagcattccgaacgtaacggtcgtaattttcgtaaacagcgtgaatgagtatctgcgctgttttgaaaacaaaaagtcttttacttctacgagcaccggaaaaccgatcgcaccgaaaataatcagaagcatcgtaataaactgcacgaaatagtcatgtctgaacgggacgagtgaatttcccgtaatatcaaagccgccgtttgtcgtggcgctgacgctcgcaaagaatccgtgcaagtacgcctgttcaaacgaatcatagtatgttaaaaaatatgttcctaagatgatgccgcctaaaaactcgattaataaaatcaaaaacagcacttgcttcatcaggttgacgataccggaaaactgcgattgattctgatccaccataatgagcttccgttcccgcagaccgatccgtttgcccataatgagccagacgaatgttccgagcgtcataatgccgattccgccgaattgaagcacgaaagccaaaatgacaatcccggccgtgctgaatgtatcagccgtgttgacgaccgttaaaccggtgacactgactgagctgacagccgtaaacagcgcgtctataaacgaccagctggccccttgtttgtgggcggccggcagacttagcaaaataaatgccaccgtcacagcaagaaaatagtataatgcaatcagctgtgcaggcgacaagatctgtatgaatttcttcagttttaatttcataagatagttccttctgcctctcaaatgtagtacgtaattattctaatgatattgggagaatttttaaaggccttttttgaaagatttttcattaccttatgtaatttgccgatctttaaacaaaaaacctctgaaacgattgtcagaggttttgtttattattttgcttccagcctgcggatgcgctcatcgagatcagggtgtgtggagaacagtgacgaatgctttttgccgttaatttttaacgtctgcaccgccgtctggtcttcttcattcacatgtcctgtataagacttcagcgtacgcagggcgtgaatcattttatccttgccggcaaggtctgcaccgccgcggtcagcgtgaaactctctgtggcgcgagtaggcgaagacgacaagactgccgagaatggaaaagataatctgaaacacgatcatcgcgataaaatgcacgaccggtgcgaggtcttctttgacaaagcggcttgcaacccatgccgcgattcgggaaaggaatacgacgaacgtattgacgattccctgcagcagcgtcatcgtgaccatatcaccgtttgtgatgtgtgcgacttcatgggcaagaaccccttccaccgcagcatcatccatctgctgcaataaacctgaagaaaccgcgacaagcgaacggcgcttagaaggtccggtcgcaaaagcattgacctccggggactgataaatgccgacttcaggcattttcgtcatccctgcggcacgggacaatctgtgcacacggtcaaccaattgctgttcttcatagctgagtgactgtttcttcggatttaacacccggacgcccatcatcgttttggccatccatctggacattccgagagaaataaaagaaccgacaaaaccgacgacaagactgaacacgagcaatgccatcagatcaatgcggccattttgtatatacgagccgacaccggtaacgcttgtaataatcgtaagcacaattccgattgtcgtaatgaccaaaaggttcgttaaaataaacagaaatattcttttcgccataattacctccgtcttttttaagatcaaaagaacttatttaattaaattataaatgatctgtttgaaaatgcaacaatttcgacgtatgatgtaaatgtaattctcagtgatatcagaaagtgaacacgtaatcaatcagaggtgaaccatgaacacgtttaaactgacccgaactgatatggtccggcttctttacgcgttaaaaggccaaggagacgcaactcctctccaaatcttattgcaatcagcggaaatgacattggatgaagcggaaagccgtctgcatatccctgaatttctgacgagattcgaacgaaaaaaagagaaaaaggaatacgggctttcaactaacgagattgtcgagctgggaaatctgtgcgagctgacgtctttaaaatcaaccgccgtccaaaactgggtgaagcgcgatattaaagatttaatcggccaccccttactcggcaaaaaatatacaattgaacaagctgtcatccttctcattgtacgtgatttaaaatcaatttatgacttcgaacatatacgcggcatattaaaaatcgcttttaacacgatcacagacagatcagacgacgtcatcagcccgatcagctactatgaaagctgcgcccaagtgattgattatcttcatcataaagcaaacccgccgatgaaggaaacgagcctgcaggagctcgtcgaagagcagacggacaagctcaaaggctgctttaaagaactcggaagcggacaatggaacgatatcagatccatcatcgccgtcacggtgctctccgttttgactttccatattcaagcctcagcctacaaaatgaccagccatttattataattcataacgcttcttcgccccggtgtctgcgccggggttttttgctgtacaacaattgccagcataatcaataccgttccgtttgaaactaaaatgcgtaaacacatcttgccagagaaaaggagatgaaaaagatggcgagcagaaataaactcttagttccaggggctgagcaggcacttgaccaatttaaatacgaagtggctcaagaattcggcgtgaaccttagctctgatacagcagcacgcgcaaacggctctgtaggcggggaaatgacaaaacgtcttgtacagcaggctcaatcacaattaaacgggaaaaatcaataatgcagcttattcgccgggacttctcggcgaattttgatatttatcggcattctcctttccgtgccggtagccgttcggattcctgcggtctgacgaatcttcatgatgccgataggagtcccaatgttcattgcgatcatgattccgctgattccagtaatgattgtaatacttttgcttaggctctttgtcatttccgttttcctgaggattttgtgttgggggctgctctgtttccccatcttgttccttctgtgtgttttcttctgatccggaagctgcatttttgtcggtttgctgactgccgtcctgactgtccggcttcgcttcttccgtgccgggcgttgtttcattgttttccggcttctctgctgccttttcttcatcaggagctgtcttttcatcagccgccggcttttctgtgtccggctgtttgctttgatcagcgtctgtttcggtatctttttgatctgtttcattgccgtcggtttgcttttcagactgtttttcttctgttttcttttcgtttcttcttatgtagctgcctgttgacatcccttcctgttttgctttttctcttgtttccatatcagattcaagagattggacctggtaggtgcccttatatttttcagtcatgtcagccagctgttttttaacgccttttttatatgtattgtcatctgtattttcataaaccgtggaaattaaaatctcttttgattcctttacatatccatgcttgctgcaatcggtaataatattattgatgacttccttaaaatcgctgcttttccaatctccgatgtcactgatgacctgtttggcgtcatggttcagcggtgtcagttcaatgacttcatatttgctgtttaaagccatttcaatgctgggattaatgtcaagcgtcatatacgcgtaagctttgttatcagaaaaaaccgggagcaaaattaaaataaacaaaataatagcagtcatcgtaaacactcccaatttaaaagggcgcagtttcagaaaatcaaaaaagctggcccttcttcccatacgcgtttcgccttcgaacgtaatttcctctccgatttcacaagtgcggtgatcattttttgtttttaaaaattgtccgtcaggggttagcaacgtgacgaattttttatttttctctactatgatccctcttctcatgagtgcaacacccctttaagataatcttttaaataaatataatcaccggtaataataatactcatggcgatgatatattttcggttccgttcaatcgtttttctgctgaccgacacaagctgctccagctgtttgacaggaagctgttttttctggtgcaaaatggacgccagctcttcattttcaacaagcgtgtaggctaccttaatcgcattctgcctcgcatcagtatgcttcggcgattgttccagcagctctttaaaagacaggccgtattctttcagctgcttctgaaaaaaaagaatttcttcccggcgctgttcctgttctatctgtttgcggtattcatcaatggaaagctccgcttcgataaggctctgcgaagattcctggtcgtcgccctcctgcacatccatattgatatgctgagcggttcttgcttcttttctgatatagtctatcacttttctttttataatcagctctgcaaatgcaagcagcgaattacctttttcagccgaatacttttcaatagcttcgttaaacgcgatcagcccgatgctgaattcgtcgtctttttcatctatatatcgtttacaaacggatgaaaccgtcttcgcgataaaaggcttatattgctgtattaaatcgttctgcagatctttgtcgcctttttgtattttttcaacagatgtttcaagcgtttgcttcttttttcccaatttaaacaaaaggctaagcactggtttcacctcagttcctccctataactactcataatcatagctaatttagtagggattcgcaaaggaagaaaaagagaaatcgatttcatttgtctcaattatgacaagccaataagacgtactatacatgatttcgtgcccccatgcagaattaagggggttttctctgtgttttttgtaacaatgctgttataaaattgttatcatatgtcttaaatgtaagcgcttcaaacaaaaaagggaacctgctttctaaaaagccagactccctttttgatcattttacgcgtgttctcttttttccgatgccgcgccggactctgtttgttttgctcctgacataaaccatccgcaaaccgcaatggcagccagaaccgcccagaaaatgattttccaggccgccgaatggatgacatctgccggaattataccgagttcctcatgggccaacgtataaagagcgagcttcacgcctacccatccgacaatcacaaatgccgccgtttcaaggcccggcctggttttcagtaaggatacgaacattgatgccgcaaaacgcataatgattaaaccgattacgccgccggctaaaataacgagaaactgaccgccgtccaagccgccgatggcaggaagccgtgttcccggaagcgttacggcaagtgcgaccgccgctaaaatggagtcaacggcaaaagcgatgtccgcgagctccactttcaagacagtctgccaaaacccgctttctttctgcgttttctgcccggcgttatctttgaatacataccgcttcagcaaatggctgaccgcaatgtaaaacaggtataaagcgccgacggcctggacctgccaaacattcaccagaaatgaaatggcgaacagcgacccgaaacgcaaaataaatgcgcccgccaatccgtaaaataaagccttcttcctttgtttttcaggaagatgcttcaccatcacagccatcaccagcgcgttatccgccgccaaaatcccttccagcccgattaaaacgagaagaacccatccatactccaataataatgcaaagtccaatccattccctccgtttcttttttctatcatccgagcttataccggcggtttttttacgcaaaaaagacctttgccgatataaggcaaaggtcttgctagacatgaatgattggcatgccaacaaagtcgatggatatgatccatgaattgacgactttgtttccggaatatccggacgctactcccctttgggatttcaagaaatatttgtttatacgctcatgataaagcctgtttcatcatttgtcaacgcttaacttttttaacaaattgagaaattttttctgttttgacccgctgttttcttctcttcaaaaacatccaaagaacgagaagcaacacaatgaatataccgagcggcagcatatattgatcgagaatggaaccgacgcttttccaattttccccgagtttcataccgaggtatacgtaagcaaatgtaatcggcagcatcgctgcatatgtatagagagagaacacccagatattcatcttcgcaatgccgcacggcaaagaaatcagcgtcctgacccccggtataaaacggccgctgaacgctaccaaacctccgtgcttctgaaagaaatcatctgatttctgcagaaattcgggttttatccatatgtactttccatatttcagcaaaaacggccgaccgcccagcctgccgatcccatataagacaagcggacctgaaacaccgccgagcgaaccggcaaacacggctccggcaagcgtcatatccccttttgagacccaatagcccgcaagcggaagaacaatttccgccgggatgaattctatactgagcgccaaaaaaattccggcgtaagataagcttttaaacgcttcaattattgatatgatgaaatcttcgatgatctatcactcccggcttacgtctatattctgaaacttaagaatgattttaacacaaaaccttgaggctgaaatatcttttagacatgcccgttataaatatagtcgtttcagatcggtatagcgggagggaatgacatgcgcaatacaacgtcccgcctgtctcctgaatgctcgtctggcggcggttacatcacttaagatctccggaaagttaccatttgcggtaagcggcgctgaccggaattcagttcatatgggcagtgcgttttgccgggatctttgccatcgccgaatctgtttttatgggagcgggaaattctctcggtcactacatggaaatgcgtgggcatttcccggggaatgattctgtataatttttttgatcaaccattgatgattttcggggacttcagcgatttaaagaacttaccgattcacatgcgatttccttttcagccggctattaccgcatgaggaaatagaatagccgctccatgaacgccgcatcacccataagttgctacacatggaacggacccgtttatccacaataaagacaaaaaggagtttttattcatgcacacgatgtggaagggttcgatcagtttcggcctcgtcaatatcccggtcaagctctttgcggccactgaagataaagatataaaattccgcagtcttcataaagaagaccatgcgccgattaaatacgaaaaaatctgcaccggatgtgaaaagagtctggagcctgatgaaatcgtgaaaggctatgagtatgtaaaagggaaatacgtcattatgacagacgaagacttgaaagacgtaaaacaggaacatgaagaaaaagcggttgagattgttgactttgtccagctgcaggaaatcgatccgatttattttaaccggtcatattatgtcgggccgggagacaacggcacaaaagcctatacacttctgcgggaagcgctgaggacgacgggtaaaatcgggattgcctccattacgatccgctctaaacagcagcttgcgattcttcgcgtgtatgacaactgcatcgtgatggaatccattcattatccggatgaggtcagaaatgccggacatgtgccgggcgttcctgagcagacagccgttaatgaaaaagagctgcagacggcgatcacattaattaatgagctgacaaccgagtttgacccggaacaatacgaagacacatgccggaaagcccttctcgccaaaattaacgataagctcgaacatgaagaagcgggcgtgacacctgctcctgccggcccgcgagaagatgtcattgatcttgtcagcgcgcttcaggcaagcattgaccggacgaagcggccgaatcgcgaacaggctgcaccggcacggacaaaagacacagcgtcagctggcggcggaggcaaaaagcagaagacgaccagacaaaaagccggaacgtcttaatcatggtgctgacgatgcagccgattttgacctctgtaccgcctgaaggcagtgagtggcgctatgaggtaaaatatgacggattccgctgtcttctccgcatagacgaaaacggtgttacattaaccagcagaaacggacagacgctgacgaatcaatttccggaaatcacggcttttgcggcccggtgttttcagcacatgaaagacaggttccccattacgcttgacggagagcttgtctatttaatcaatccgtacagagcggactttgagcatcttcaaatccgcggacgtttaaaacgaaccgaagcaattaaaagcaccgctgatagacggccgtgccgctttctggcatttgatctcctcgttctggaaggcgcgggcaccgtctcattaccgtatgtgaaacggaagcgcgccctttccaatctgcttaaagaagcaaatcttcccgcctgccctcatcacttagcggaagaagcgattcaatacattccggagcacactgactttgacgcgctttgggacaaggtcgtccgccatgacggagaaggtatcgtagccaaaaggacttccagcggatgggcggaaaataaacgctctcccgactggcagaagtataaacatatgaaaacggctcacgtgctattaaccggattcaatccgaagaacgggtatgtgacggcctctgttttgaaagacggcatcgtcgtcccgatcgcttccgtttcccacggcatgcaggcggaagaaaaaaacgccgtcagaaccattatggagacccacggaaaaaaacaaaaaagcggcgagtatacacttgagccttctatctgcatgaccgtgcagtatttaaccatattgcaggacacgctgcgtgaagtatcttttgtgtcctttcagtttgaaatggattggacggaatgcacgtatcagcagcttatcctccgctctaaaacgctgccgccgaagctgcagttcacaagcctggataagatcgtttttaaaaaacgtgaaaaaacgaaagcagatttccttagttatatggtgaaaatgagcgattttctgatgccctttcttaaagatcgggccgtcacggtgatccgttatccgcacggcgcgcctggcgaatctttctttcaaaaaaacaaaccggactacacgccggactttgtcacaagcgtgtttgacgggagccacgagcacatcgtatgcagcagcgtaccgtcacttctatggctggctaatcagctggcgcttgaatttcacgttccgtttcagacagtgcattctgaaaggcccgcagaaatcgtcattgatcttgatcctccgtcaaggaatgattttcctatggcagtggaggctgcgcatgtgctgaaacagctgtttgactcattcagcatgacgtcattcccgaagctctccggaaataaaggcattcagctttacatcccgctttcaccggaagcattcacctatgaagaaacccgtgcgttcacaatgctcatcgccgattattgcgtcaggacgcgcccggatctttttacgacagagcggtttatcaaaaaccgaaacggcaggctctacctagattatttgcagcatgccgaagggaaaaccattatcgccccctattcgacccggggcaacgaattgggaacggttgcggctcccctttattggagcgaagtcaactcctctttaacacctgatgattatacgatcgatacagtagtgaaccgcgtcaggacagagggagatccgttttatgatttttaccggaatccgcaggacggcccgctttcaatcgtgcttgagcaaatcaagagaaagagctgacgcttttggtcagctcttttcagtctgatacgtgcacatcaatttttctttggaaataaataaatagcaggagtaaggaatgtttttgagggtgagctgttttgcagtaaagtataaaatcggaagatgggccgctttcttaaacagcctgtagcagccgctggacggttttatcacatcaaaaccgagtctcgccgctcctttatgaagcattgtaatgccgacgactcccttaatctcgtctttccgtttatgctggttaatataatccgctaaatgaggcatggattgatataccttctgatatagcataatcccccttctgaccgcgctttcaataggctgcagctctttcaggagtttgacattatgaagatgaatcttaactaacacgtcgttttttttaatcctggttccgtcgctcaggatgacatcttttcctttatatctagtcaaacggacgcggaatacattcgattgccgtttatcaatcagcgtcagccgggtaaagaagaaataaagcggatcaagtaagtaccatatagacagcagacagcttctcacatgttcaccttctttatattcaaagcaccctcatattttggcatgaggcatgacacattatgattggtaaataatgatgcagccctgtatcagcttatgcaaaaaccgcttcaggctctactgtccgaaacagaaaaaaacactcttcatgaagaagagtgtctgtatccgctttcttttaacggaaaagcaaatgctggctgtgaattcctgcttttttcagtaaggctatcagctgttcctgttcctcaggcataagtcctgaaaacgctctcgcaattctcaatgaatgaatcggataaattttatccaaatactcgtttcctttatcagttaaatgggcgtaaacagaccgtttgtccttcgggtcttgttctctgaccaaaaacccgtttctttcaagcttgtcgatgacataggtgacattcccgctgacaagcaaaagacgcgacccgatttgctgaagcttttgcggtcctctcgtatagagcagctccaaaacggcaaattcagtcggattaaaaccgtgttctttactatcgcggatgctgtgttcagacacactcttgaaagcccttgcaaaaactttgtacaaattcatcgaacgcatcacttcttcttcgttaaatgataatctcatcatatctaccccgtatttaagatttttataaaaaaataatgtaaacccttacaattcataagagtcgttctttgttttatattctattcgtgccgtttttcagaattccttcttttttatataaaaaaatacccttatacatcatttaatttgtataagggttccgttctttatagggaatgttccgaaaaaaatacgcgtattcctttctcagctccgtaattgtcatggaattaagtatttctttcgtatagactccgatctgcagaagctttttggaataatggtttctctctttatccaatgcattttgaagcaaacgactcatgacggcctcctttgttttccgttattctatgatcagaataacgcttttatatcaaagatgtataaagccattgtaaaacttctgtagattatgatgtttttcggtaaagaccgttctggacggctctgagcagcggaaaagcgtgttccccggcaagctgcatgaacgcctccagcatttcatcgcgtttcatatctaattcaatgatttcttttgccagcgaaaccgctttttctttctccattcctatccttcctcctcattgtatctgtacaataagcataaaacgggggcacagaaccatgcattaaccttgtcaatttttctgccgctttttttctaaaattttctattccgcgtcagaaaacctgacaagcgtcaggttttttctctttttttcttatataatatgagtaaaagacatccaggggtggaaaaatgacgacagacgaacaatcttacaaagataaaaaagtaatctcgatcggcattgtaagcgaattaaccggattgtcagtcagacagatcagatactatgaagaacggaaattaatctacccgcagcgatcatcacggggaacgagaaagtattccttcgcggacgttgagcggctgatggatattgccaacaagcgggaagacggcgtgcagacggctgagattttaaaagacatgcggaaaaaagaacaggctctcaaaaacgacccgcagctccgcaaaaaaatgctggaaggacagcttaatgctcattttaagtataaaaaccgctgatcaaaaaagtccgcctcctgtgagacggactttttttataaagcatgaagaaatgcagttgcaatgccgaaataaattaataaggacaaaatatcgttcagcgtcgtaatcagcggtcctgacgcaatcgccgggtcaatgttcagtttatgaagaataatagggacgatcgttccggccatcgtaccgataatcaacgttgcaagcagcgatgaaccgacgacaaaaccgagcgttaagtctttctgccagacggttgcgacgatcgtaatcgcgatcgcacagacgatgccgatgtagataccggttcttaattcacggaaaatcagtttaaagatggtttttttattcatttcttctttagccagtcctctgatgacgacggcaagtgactgtgtgcctgtattacccgtcgttcccgcgatcatcggcatgaaaaacgcgagggcgactactttttgcaatgtatcttcaaaataattcagaatgcttccggaaatcaatccgataaacaaaagcagaatgagccacggcaaacggcggtacgccgccacgtatgctttcgtatcaaatgtaatcgccttaccggaggctgcgaatttttcgtaatcttcatcggcttctttaatcacgacgtcaataatatcatcgacagtgacaataccgacaagcacattattttcttccacgatgggaatggctaaaaagtcataccgctggatcagccgggcgacttcttcctggtcttggagcaccccggccgagatgacacgcgtaaacatgagatcctgcactttatcgtcaggctcgccgagaattaaatctctgtaagagagcactccgacaagctgcttgctgtcattaatcacgtacaaataatttattgattctgcgatttctgcaaagcttttcagcttcacgaccgcatcttttactgtataatgctgcggaatccagacgaagcggttcgtcatcatccggcccgccgattcttgcggatagttcatcaaaagctgtacggcctttgattcctcagcctccatactggataaaagctgttctttcagttcttcatccatctcttcaagcaatgcggcgagatcgtcgttatccattttattcattgcgagagtggctttcgttttaccgaccttatgcaaaacggcaagctgaaattcccgctccagctctccgatcatgtcggtgatgtcatcaaccgtcatatatgacagatagcgggcccggtgcttttccggcatttctttaaataaaaatgccatgtcatagggctgaagctcatctatcatgtttcggaattcttttatttttccgtcccgcaataaaatgataatgcgtaatatgagttcgtcataggtcatgttttggaccatcgggactcgtacctcctttacggagacgcgccgtccgtcaagggaagtgcggcggtttgtctcctcatcatgtcgtcactggttatctggctgtatatgggtacttcttctgacatactcgaatggggagaatccatactccgcacctccttatcatgctcagtcgtgtacgttttgaggcataaaaaaaaccttccgatatgaaggcgaaaacaagcacggcaaataaacgtgcggggcctccaatcgtagagctttagcactgtatggcataggacagccatccagctgcgttaagaatcaccttatgtcgatgattcctgttgacccattggcgtctttggacatttttgggcagcagcgtatctccatacaggagcctcacctaacgaagttcttatttgaattgacacactgagattacagaaaaaaaaggaatgtgtcaaccttaaatttgtgatttcagcacatgcctataaaataaacggaataaaggcataaagcccttattccggcaaatcgctttcatcgtcttctgaaaggaaatgataggattcatgcagcatgagcgcgtattccccttcttttgtcggatgcggtacatactcagcctcgttgatatactgctcttcccttttcttcatatgacagacctccttctcaattttagattgtccaaaagaagctccgttatcataggaaagaaaaaatcacttgcggaacgggacatgcagctatatttttcggatcgtaaaaaagttcctaagcagccacgggcccggtttgaaaccgagcgttaattgccacgcgccgatcgcctgcagtccgaactcccgaacgagaaccattttttcactcatgctccgcacatcctcaaaccacacttcatgcgttcttccattttcatcagtataccggaagtaaggggaacgctcctgctgggaataacggatcattgattgatgcttcatcgccgtttccatggcgcgctgattggagatggcagatccgatcgttccgggacggtacggaatcacccaatcatacccgtacagcggaacaccgagaatcacttttcttctcggcaccctgctgatggcaaaattgatcgtttgcctgacctctgttaaaggcgccacgggtcccggctcactgccggcgtggtgccagtcgtacgccataatgaacatataatcgacgacggctccgattccgccgtaatcatatcccctcagccacggcactgcatcacttgttttcgccggaaccgatatcgttaacgcgagctgatgctctgaaagccgggtttttaactgccggagaaatcctgtgaagagatccctgtcagcttctctgacccgttcaaaatcgatatttacaccgccgtatccctttcttaccgttaaggagacgatattgttgacgagattcgttcttgccgccggattctgcagcacttgatgggctaattccggactgaatcccccttctgtcagattcgtaatgacggcaagcgggcgcactctgttctgccatgtggtttctattgcggttctgtcgtttaaatcgttcatgatatctccattcgggccgaaatgatattcaaacaaagaaatcgccgaagaatacggcgcaaaatcattaatcagctctctatccgcttcaggcgtccgaatgacataaaattgcagggttcccgcaagatagttagagatatcagggatcttcactttcatacccgtccgcagccggttcggcggaatatccgggtttgcctgcatcagctgcatctgcggcacataagccttacctgcgataacggcatacgtatcattcggctgaaccgtatattcattaagagggattaaaagcgcctgccccggaacgatattcgtttcctcaagcccgttgacgcttctgatgctgtcaacagggtatccgtactttctgctgatggaaaataacgagtctccagactgcactgtatgaacaaacatagatgtcctccgtttccttttgatcaaaagggctcttcttatctttatgaatgatcttccggtccgattccaaactctgttcggagaaaggctgtttacaaatcagacatgatcaactatgatgatgtcattataaaaaactgtataggaaacgcactaggggtgctgttatcggctgagataaaacatgcggcaggcgtgttttgatcccttataacccgatctggataataccagcgtggggaagtgcagattgaccggagcgcagggtttttccccatgcgttttcgttctgctgctgcatattccctcggatatgcagttttttatttttcattaaaaaacgggggaggacaccgcaatatgaaacttacgatcaatcgtctttcgtaaaatcaactctttcatacttacgactatcgataagaaagcaggagatcacaatgaaaaattggaaaatgagagaaattgtcgtcatgtccgtcatcagtgttgtatttgctgtcatttatttagtatcaactcatgcaagcaatatagcggcaggatttttcggccggatgagctacgaaccgatttacggtatctggtttatcgtctcggtgattgccgcgtacattattcaaaaaccgggagcggctctcgtttctgaaatcatcgccgcgtttgtggagtgcttactcggaaatccgtcaggaccgatggtgattctgatcgggatcgcacagggaatcggtgcggaagcaatctttttagcgacacgctggcgggtgtataccctgcccgtgcttcttttatccggtatggggtcttctgtgacaagcttcatttatgacttgttcgtttccggatactctgttttgaatccgggtttattagccgtcatgcttctcatccgtctggtctcaggtgcgcttcttgccggccttctcggcaaagcaatcagtgatgcgctggcttacacaggagtgctgaacggcatggcgctcggaaaacaattcaagaagaaaaagaaacaggtgaaccaagatgcaggcatctgaaccccttctatccgccggccgtcttaccttttcttatgatcaggatgaaaagccgatttttcaaaacgtgtcctttcagctccgcaaaggagagcgggctttattgctcgggccgagcggatgcggcaaaagctcgctcgctctctgtttaaacggtctgtacccggaagcatgcgatggggttcaatcgggaaccgtttctttatacggaacacctctttcacacctgacagaacccgccgccagatctatcggcgtcgtgtttcaagatccggaccagcagttttgcatgctgaccgttgaagatgaaatcgccttcggcctggaaaatttgcaatatacaaaagaagatatggacgcaatcatcgatgacgttttagaaaaattagagatcactcatctgaaaacgcgaacgatcgcttcgctgtcaggcggttcaaaacaaaaagtggcgcttgcctgtatcattgcgatggaaccggaactcattattttggacgaaccgacggcacagcttgatccatattcggcacgtgaattagtgcggctgatcaaagatcttcaagcaaaaaaaggcttcggccttctcgttatcgaacatcagcttgatcactgggcgccgtggatggacaggacgattgtccttgacgaaacgggtcagaaggtgatggacggagagacggatgttatctttgaaacaaggattgaagagctgatacagctcggcattccgattccgcgtgtgatctcattgcaggagcacgtcagcattccttttacattgtgtaaagaaaatctgtttcacgaacctgtaccatctctgcccgaaccccggcccgccgcgctttcggcagaagacgcgctgagcgttcacgaactgtcattctcaagaggagcagaagtcatttttcaggatgtgagcttttccgtaaaaaaaggttcaatcaccgcgattgccggtcctaacggaacaggaaaatccacgctcctttctgccgcggccaagctcatccgtccgctgggcggagacatcaaaatagacggcagaccgattgattcctattctgaaaaagagctgcggcgacagatcggatatgttttccagaatcctgaacaccagtttgtcacagattccgtcattcaagagctgatgttcggttttgaaagcaacagagccgcaaaggagaaagctcttcagctgttaacccgattcggcatgagacgccatgcctcacagcatccgttttctttaagccaaggacaaaaacgcaggctcagcgtcgcgacgatgcttatgcacaatgtgaacgttttgatgcttgatgaaccgactttcggacaggatgccaaaacggcgcgggagtgtatgcaaatgctccgtgagattcaaaaggaaggaacggctgttttgatggtgacacacgatatggaactcgtctcggattatgccgacacgatccttgtgctctgcggcacgaagctggtgtaccgcggaacgcccgactcattgttttctgatcatatcggaatcgcggagcgggcgcatttagctttgcccctgcggtatgaatggatgaaacacgacaggaggcggaaaaatgaacttgcggctggaggctgttaacccgtcaataaaggcggcggctgtattgttatgcgtcattatgctgtcatttatttataatccgtacacccctgctttgttttatatcatcattgcgggaggcgtcctctcggcggggcgtgtgccgctgaaaaaatggctgctgttcacgattccgtttgtcattctggccttcggttctttatggacagccgccgtattcggaaacgtcccgacaaccgggagcaatctgctgtttaaactcgggccgattgccgtcaacagtgataacgcggcgctcgggatttctatcgcgtttcgtattttatgtttttccgctttgtcgatgatgtttctttttacaaccgatccgattctgttcatgctcagtctgattcagcagtgtaagctgccgcccaagcttgcatacggcgttatcgcgggattccggtttctccctcttctgaaagatgaaatcctgatcatccggcaggcgcacagaatcaggggtgcggcgtctgattccgggctgaaaggaaagctctccgccttcaggcgcttcaccattccgctattggcaggcgcaatcagaaaggcggaacgcacggccatcgcgatggaatctaaaggctttactgggagccgaaaccgcacgttttacagaactgttactgtgcgccgcgccgactggtgctttttcctgctcgtgcttctgttattcggcgcaagctggctcatttcattgttgtttgtataaaaacaggccgccggagtgattcggcagcctgttttgttatgtatgttattgatgataattgagagcctgagcgagattggacttgaccgtaatctctgagaaattaatgccgagctgtacggcggtttgagcaatttccggcctgattccggataaagtggacgtgacgccgatcaatttcagcgcttcaattaatttaaaaatctgatgcgccaccatcgtatcgacaaccactacacccgacaggtcaattaacagatgttcaatcagccgttttgcacatgtgctcagcgtattttcaagaatgaatttggcgcgctccgtgtcaatatcgccgacaagcggcagcagcgccgtccgtttgctcagcgtgataaccggcgagcttaactccaaaatcatttctctttgcgcattcagctgcatttttgagttatgctcagcatgatcgacaaacgtgtaaatcgtaaaatcaaatacttgtgcaattaaattctcccatttcttcctttctccctcggcaaacgaagattcatgtttatcggcaaacgcatcataataactgatgtatagtctccggtttctcatgaattcacggaccacatactggacgggagtatccagatgcttctggtctttcgcaagctcaatcacccaccgctcgaattcttctaaaaattctttttccggcatgatatacattttattaatatgccggtaaaattctttatcctgctccgtcagttcttctgtgatgacgggatttgtcaaagaataaatcgaattcggatccgaatcttccatcgtttcgatccactctttcgcaatttgatccacttgttctgaaaaatagctgtataacgcttcatttatcttcatctctcttctcctttcccatttccaattatagcgtcagcgggtcatgaatgaaaatgaaagctgtcaaactatccatttatttgaaattttttagtccgatagattacgccttttttatgaaaatgcttcaaatgactctttccggccggcatgctctgccataaaatagtagcaacacccttgtatccactggcaagcataaaaaaggagggcttttttatgaatggtgaaatgcatttgattccttatgtcacggatgaacagatcatggatgtgaacgagcttcctgaggggattaaagtgattaaggcgccagagttgtgggcaaaagggtttaaaggcaaggatattaaaatcgcggtccttgacacaggctgcgacatcaatcatcctgatttgaaagaccggattgtcggcgggaaaaacttcaccgatgatgacggaggcaaagaagacgtgatttccgattacaacggacacgggacacacgtttccggaacgattgcagccaatgattcaaacggcggaatttcgggtgtcgcgccggaagcaagccttttaatcgttaaagttctcggcgggaaaaacggcagcggcaaatacgaatggatcattaacggcatcaactacgccgttgaacaaaaggcggacattatttccatgtcactcggcgggccaagcgatgtgcctgaactgaaagaagcggtcacaaatgcggtaaaaagcggtgttctggtcgtttgcgcggcaggaaacgaaggcgacggagacgagcgtacagaggaactgtcgtatccggccgcttacaacgaagtgatcgcagtcggatcagtctcaatcgcccgtaaatcgtctgaattttcaaacgctaataaagagattgacctggtggctccgggagaaaatattctctccacccttcccaaccataaatacgggaagctgacgggcacttcaatggccgccccgcatgtgagcggtgcgcttgccttaataaaagggcttgaacaggacgcgtttcagcggacgctttctgaggctgaagtctacgcccagctcgtgcggcggacccttcctttggacatcgccaaaacattggccgggaacggatttctgtatttagacgcgcctgaagtgctgatggaaagagccgaacaggcacagctgctgtctttctgatatttttctcgtataatgattgatcagtttgtcacatcaccaatttttaaattgtgagattttctattgacagtgatctgaataagctgataagataaccaacaaatgatgtaacttttcaaaaaaattgaaatactttctcttatcgagagttgggcgagggattggccttttgaccccaacagcaaccgaccgtaattccattgtgaaatggggcgcgtgatttttgcgccgagacgattgtctcataaggcacggtgctaattccatcagacgtgatctgagagataagagaggcttgcattttgaagttaaagcctctttctctcatgagaaagaggcttttttgttacatctcacttaaaggaggagacttaatgacaacaatcaaaacttcgaacctcggttttccgagaatcggcttgaacagagaatggaaaaaagcacttgaggcttattggaaaggaaacactgataaagaaacgtttcttaaagagcttgacggtttattcttatcagctgtcaaaacacagcttgaccaacatatcgatatcgtgccggtctctgatttcactcattatgatcatgtgcttgataccgccgtcagctttaactggattccggaaagattccgcagcatcacggatcccgttgatacatactttgcgattgcccgcggtgtaaaagacgccgtttccagtgaaatgacgaaatggttcaataccaactaccattacatcgttcctgaatatgacgaaagcattgaattccgtctgacgagaaacaaacagcttgacgactaccgccggatcaaagaagaattcggagcggaaacgaaacctgtcatcgtcggtccgtatacattcgtcacgcttgcgaaaggatacgaagaatcagaagcgaaagcgattcaaaaacgccttgttcctctttatgtgcagctgctgaaagagcttgaagcagaaggcgtcaaatgggttcagattgatgagcctgcccttgtgacagcttcttctgaagatgtccgcgccgcaaaagacctctatgaatctattacaaaagagctttcaggactgaatgtcctcctgcagacatactttgattcagttgatgcatatgaagaactcgtttcttatcccgtacagggaatcggacttgatttcgtgcatgataaaggcagaaaccttgagcaattgaaaaagcacggcttcccgaaagataaagtgctggcagccggtgtggtcgacggccggaacatttggaaaatcgatgtagaagaacgccttgatgcggctttggatatcctcagccacgctgatgttgaggagttatggattcagccttcaagcagccttctgcacgtgccggtggcgaaacaccctgacgagcatcttgaaaaggatttgctgaacggcctgtcatacgctaaagaaaaactggcggaactcggcgtcttaaaagaagggcttctgtccggcaaagcggccgtcagtgagcagatcgaagaatcaaaatcggcacttaaggctttaaaagcattcgcaacaggagcgaactccgctcaaaaagaagagctgaatcagctgacggaaaaagatttctcccgtccggcaagctttgaagaacgattggcgctgcagaatgaatcactcggtcttccccttctgccgacgacgacaatcggaagcttccctcaatctgccgaggtgcggagcgcacggcaaaaatggcggaaaaaagattggacggatgaacagtaccaagcctttattaatgcggaaacgaagcgctgggttgacattcaggaagaaatcggcttagacgtgctcgttcacggagaatttgagcggacggacatggtggaatacttcggtgaaaagctggccggattcgcctttacgaaatatgcatgggtccagtcttacggttcacgctgcgtacgtccgcctgtcattttcggagatgtcgaatttatcgaaccgatgacggtaaaagatacggtctacgcccaatcgctgacggaaaaacatatgaaaggcatgctgacgggacctgtcaccatcttaaactggtcattcccgcgtgtggatatttcaagaaaagaaatcgccttccagatcgggcttgccctcagaaaagaagtaaaagcgcttgaagatgccggtattcagattatccaagtggatgaacccgcgctccgcgaaggactgccgttaaaaacgcaggattgggatgaatatttaacttgggccgcagaagcattccggttaacgacgtcttctgtgcaaaatgagacgcagattcatacgcatatgtgttacagcaactttgaagatatcgtagatacgatcaatgatcttgacgcggatgtcattacaatcgaacacagcagaagccacggaggatttttagagtacctgaaagaacatccttacgtgaaaggcctcggactcggtgtatacgacattcacagcccgcgtgtgccggcaactgaagaaatctatcaaattattgatgacgcgcttgaggtgtgtccgactgaccgcttctgggtaaacccggactgcggactgaaaacaagacagcaggaagaaaccgttgcggcattaaaaaatatggtcgacgccgcgaaacaggcacgaaaaaaacaagctcagcttgtataatgaaaacagccatccgtaaattgcgggtggctgttttttctgggcatgctacttattctgcagcgcttctgccagttcatacaatgaatcatactgcttaatttgatagccccgcccctctttttgcaaataccctttttggcagaattgcgtcagcacatgcaagagatgacggtaagatacacccaaataatcacagaccgttacgtgcttctctttataaacccctttataagccgtctgcaaaataaaatcagcaagccggttttcaagcgggaacgccagactttgtgaatatttcgaagccataagcgttgccttagcacttaaaaacttagccagctcacgcaggaatttcgcatcctgcagcaattgcacgcggcagcggtaaataggcagaacaaaacaaacagtcttcgctgaggcttgaattccttttgtgtaatacacttcatgtaatagttccatctctccgatgtaatcatttttgttgataaaattaattaaagaaactttcccgttttggtgggttacatatattttcgcttttccttcaatcacgtaaaacaggaagtctggcctcctgccctcttgaataatccattcgtcccgctcatattcgcgcacttccataaactcttcagcggggaaagagaataaatgcgcgattgagtgtttttctaactgatgccgctttttctcgcctttataaatttccatcgtccaccccaaaaatatgagatatctcatattgtctttatgtccttacatgataacatgccaattaaaggaggaacgggaatgaaagcatatcgctggatgagtctgcatttttttagtttttttatgacatggggtgtttttctgccctattggacgggatggatggtgcatataaaaggggtttccgtatccgaagccagtttcattatgagtctgggcctggcggcaagagggatttccacattatttttcttcccttatttatcaggaaaattcagcagcaaagccttattaaacggcgccagaatcgggacgcttctcgcacttttatgttatattccggctgattcttttcaaagcctgcttcttgtcacattagtgctgcatgtgttttacccggctttaatgcctgctttagacagcgcttgcggcgtccttgtacagcataacgaattaaaggcttatgggactagccgacagtggggatccgcgggttttgtttcagccggcgtcatcctgtccgtctttacaggtatattcggagatcaagcgattttatgggcactgcttttgggcgccctgatattcgcatccctaagctttatgcatgcgccagctgttctttcaaaacggccggaaacagaccgtgcaagaaaagagggcatgtttgccttattccgcatcaaatatttcggtctggtgctcgcaatcgttatcttactgcaggcggcacatgcatcttactacaattacggttatctctttttgcaggaaatcgatgcgcccgcatatgccatcggaatcatcatcaacatcgccgttatcacggagattatcttctttgcaatcgctgaccgatactttcatcaatttacggcaggctctttgctcgccctggcggcgcttggtgctaccgtacgctggatactcgtatttgcctttccgcatgtcatcattttctgtcttgcgcagacgctgcatgcctgttcattcgcgatgggacactatgcatttatgaaatacttaattaaaaatatttcacccgcgcaaatcccgaaagcccaaggtatatattcagcgcttgctctcagctggagcactgcggtatttactattttcggaggttttttatatgaaattgaaccccggtatgcctttatcggaatgattgtttgtacgataccgtccatgcttctcgcccttttatacagaaaacttgaaatgaaaaagagcgtttttgcaggaaacgcacaagatatatagccatcgctttatagacgatcacatgtcccgctgtcattttgaccgattttgtgaatgctgtgcgatgtattttctctatatttaaagtatttccttcatatatgatgaaattaatgaagggaattcgttcagaaacttggacagaatcagtgaatataatgatacagtactgcttacgctcatttgggggaactttgttcgcaataaaatgattttcagccaactcataaggagggacattgtgtcacagcctaatatgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacaggacccccgtcaagtcttgcggatattcttaacctgaatgagagcgtccgggatacgcttgacagcttaatgaaacaggagctccttctcggttcaaaattggacagtatctcaaatatccctacattggcgggaccgacgggggccacggggccgacgggggccacgggtgcgggtcttcaagggattgttgcttttaatccgctgatcgcccctacttacacgaccggacaggttgtcttgtataacggcagctcttatgtcgcaaacgtaaacagcccgtcgggaacccctgaaacctcagctgactatacacttttagctgcggcgggaagcaccggcgctactggttcaaccgggcggaccggaattaccggggctactggcggcactggatcaactggaattaccggcgttacaggaccgaccggagttaccggggctaccggcattacagggcctccgggaagcaccggaacaagtctgacagccacttccggctatgcgagcaatacgggcggcggtgttgtcgcagttattaacggcggcacggccatttccttaccgaatgaacaaaacctctcagcggatattaccgctaatgccgcaaatactgtattcaccgttgctccggcaggacggtactatatttcctaccatattaatttaacggccggcctgctagtaagttcgcgcatcttaatcaacggcactccggctgcaagttcgattattgctccggtcgcgtctttggcaaacttcaataactcctttattgtgactttgacagcaggcagcaccattcagctccagctgttcggattattgggtgcggccacattgcttagaggaagtgccggcgcagctttaaacattattcgattatcttaatggaacatgcaaaaaaaggatcaggcgtttgtccgctgatccttttttaattgagacagaagttcttgcgcgggtttaaattgcggattgaatttcacggattttttggcgtaagcgatggccgtcatatcatggtttaatgcagcatggcatttcgccatataataaaaagctctgaaatcggcggcaccttttaaaatgaagtgatcagcgttttctccttcaacctgcgttccggcttcaaatgctttgattgccgctctgtacttttccaaatgatataatacaaggcctttataataatgaagattgctgtaatcaggataaagcttgagcactttttcaatcccttgttcggcttcttcatatcgcttgagctcaagcaatattgtatattttagaaaatacagaagagacggaggcattcgtttctcacttaaaaattgaaatattgagccgttgacaagatgtaatgctttttcatagtcttttattctgtaacattcacttgccagatgatagactagccacggatcaggattttcctctgaaagttcttcatttaatatgctgatattccgtttatgtttttgtttgattttttcttcctgctccaagtagccgtagtgatgaatcacacatgggagcgtgaaaaaagcattgttttcttcctcattgggagccgagatattctcgtgaattctgccttgatacagaaggcctttatgattgcggaacagcctcggctgcatgctttcaaacgcttcgttttcatcgagctgcttccccgtataattgatgattttcaaaagtccccggctcggtaatccgtcatgaagcagagaagttaaaaaacggcccgtctcctgatcgagctcttcatccgcgtcaagcactaaaatccaatccccttcggcatgctgcagggcgtaatttctggcctttgcgaaatcattctcccattcgaaatcaaacactcttgcctgaaagcttttacatatatcttttgtattatcttgtgatccggtgtctgcgatgacgatctcatcagcgatgtcttgtacacttgataaacaacgggagatatatctctcctcgtttttcacaatcatgcaaagagtcagtttacattcagcatttccgctcattttctcacctttcccgattttggagttgttgattgaaccaaggccgtccaggagtgccgttcatcgttatgatgacaggccgcacccatctgacggcaggttcggcagttgattctgcatcccattcctgaagctgcctgacagcccgcttcgtaatgggatgcgcccggaattcgcgcgggctttcacaaatgaattttttcgttcgttccgtcactgtcttcatttcatgaaagtgccgcgcatacatctgcttctgttcttcttccaagctgatcattaaaaacagccggccgcccgtttccatctgccagcggcacaatgcggagaacagcctgatttcttctttgtaatttgaaccccttcttttatccacggtcacagataatatatttaacagcgccatcgtgagacaatgcaaggcttcaaaagatgtctgtttcgcttttgagatgctcggatacggcatatgcttcacccgtctctttttttatgaacgctccccgccttttttcttccaatcgcagtcctcacaatccccgcactcacagcagccaatacggccgtaaaacaggtcgtcacacggatcttccggatcactgggatcgtccggattccacgggtcatcaggatcgcccggatcactcggattacttgggtcgtccggattccacgggtcatcaggatcaccgggatcactcggattacttgggtcgtccggattccacgggtcatcaggatcgcctggatcactcggattacttggatcgtccgggtctatacaggcttcagcatcctgtaagtagataatgtcttcaagcttcgtctgcaaaaggagttgtgatttcatgacggtgcgcaggagccgttcagtgcttctattgattgatgataattcccctaaggagggatcgccggaagcgctgagaaacatttgaatcctttccgcttccgcctgcagaatatgggatagtccgatttcttccatagccacggatgaaagaaggaggttcagggtctcacatctggagagtgtaatgtcgggggtgatgttcggtatgtttggaagagtcatcgatttctccctcttttctcttggtgtcattatgcaaaagtgctatatcgtattcttattccgggagagaagagatcattactgatgttttcgttaataaaatatcccggatatgaaatccgggatattcgttcgtttctttatttcaattcaagtttgacgtctacatttcctcttgttgcttttgaatacggacagaactcgtgagcggcgtgcaccagcttctccgccgtttctttatcaagatcttttgtatcaatgacgagcgttacgccgattttgtaacccccgtcactctcatcttttaaaaggctgacctgtccttcaatttcagaggtcatgtcgattttttgtttttgggcggcgagttcaagcgctcccccgaagcaggcagcatatcctgccgcaaagagctgttcagggtttgtgccggtttctccgtctttttttgcattcggcatgatgatgtcaaaatccagcaccccgtcttcggatttaatatgtcctgctcgtccgccgactgcggtcgcttttgaagtaaataatgccattattatcagcctcctcattgtacttactgtatatattgcccctgctcatatttttaaacatgattgcaataggaaatgggccgtttttcggctacaataggggtaacgttaacaaaaaagagttggtgaaagaatggcagaaaaagattttgaacatatgaaactggagaatcagctttgttttttgctgtacgcaagctcaagggaaatgacgaaacggtacaaaccgctgcttgataagctcaacgtaacttatccccagtatttggcgctgcttttattatgggagcacgaagaactgaatgtgaaacggatgggtgagcttttgcacctggattccggaacgctgacaccgatgctgaaacggatggagcagcacggaatcatcatgagaaagcggtcggctgaagacgagcgatccgtgacgatcaggctcacagatgaaggacgggccttgcagaatacagcggcagatatccccattgccatgctggaacagacgggactgtcaaaagaggaattaaagcaggtaaaacagtcgctttatgaggttttgaaaacgctgcacggcaaaaaataaggatgccccgaatgggcatccttatttttattctgctgccagaagcttcacttcaatatttcccgctgtcgcttttgaatacgggcacacaccgtgcgctttttggataagggcttcaagctcctgtttctcaatgccggatgctttgacctcaagggtaacgccgagtttatatccttggtcgctttcatctttcagcagactgacatgcgcagtgacctctgtttcaatactcagacgctcttttcttgctacgagttgaagagcgctgtcaaagcaggctgaatatcctgcggcaaacagctgttcagggtttgtggcttgttcgagcttttttgctcttggcgttcccggcatggcaacatcaagattcagcaccccgtcagaagacgtgactttcccttcacgtccgcctgcggctgaaacggttgcagtaaataatggttttgtcatataaattcacctctattatattgtgtacaatttaattttacgaaatataatggaaaccgtcaatctttccgcataaaaaaagcttaccctttttgaaggataagcttaaaagattatacccggatttgtccgtttcctttgatgatgatttttgtagatgttaacgccggaagtcccatcggccctctcgcgtgaagcttttgcgtgctgatgccgatctcggctccgtatccgaattcaaaaccgtccgtaaaccgggttgaagcattatgatacacggcggcggcgtcaacggcggtctggaagtaagccgcatgctcggcgttctccgtcagaatggcttctgaatggtttgtgccgtactgctgaatgtggcggaccgcctcctgtacgtcctgcaccgtttttacactgagaataggcgccaggtactccgctccccaatcggcttcttctgcttgtttcgcttgaggctccagtccgcaaatcacctggtctcctcggagctccacccctttttctgtcagctgattcagcagctttcgtccgtgttcttcggcccatttttcatgaatcagaagagattcaatcgcattgcagaccgaaggacgctgtgttttggcgttgatgacgacctcgcttgccataaggggatctgctgactcatctatgtacacgtggcaattgcccgctccggtttctaaaacgggtacggttgattccctgaccacaagatcaattaaatttttaccgccgcgcgggatcaatacatccagcccatcatttaatgtaaagagctgtttggcggtttctttgcttgtatcttcgatgagctgaacggcatcaatcggaagctttgacagcccaagtgcgcgtttcatcacactgacaagcgctatgttgctgtggatggcggaagaacttcctctgagcacaaccgcgtttccggttttcagacagagtgtggccgcgtctacggtaacgttcggtctggcctcatagatcatgcccactactccgaggggcacgcggatcttttcaattgataatccattctcttttttaatggtctccaatgattcaccgacgggatcttcaagaccgattagcagttccacggcgtccgcgatatcgagcaggcgtttttcatcaagcgtcagcctgtcaataatgtcaggtgtcaatcctctgttccgtcccgcttcaatatctttctgattctctgttaaaatcagctgccgttcatttctgagtccgtctgcaatacattggagcgcttcgtttttttcagccgtcgttttcatgaccatttcggcagccgcttcttttgccaaagccgctttttgcaatacttcactcatttgtgttcccccttgtcaaataaattcacccaatcatctctgtgaatcacttccacctgcttcgttcctgaaagctggtcgctccgcttccctttggcttctaaaatttcatcggatgagtactgtgtctgccctttgccgataatgccgccgggccctctgacttccactacggctcctttcggaaaactgccgcagacatcggcgacgccggccgggaggagacttgacccgttatggatcatcgcctgctccgctcccccatcaatgatgatttcccctgatatcggagaatgaaacatgatccattgccgtgtattattcactgaggacaggtctttatcgccgatataagtgccgtcgccttttccgtttaaaatcaccatcagtttttcacgtccggagccggttccgataaacaccttcaccccgagcgacaatgcggtctgggcggcgagaagttttgacttcatgcctccggtgccgacctttgagcctgctgacccggcatatccgagcaattcaggtgtgatgtcattcagatagtcaaaccgctttgcgtccgggttttcattcggattggcatcgtacagcccgttaatgtctgtgagaatcattaattggtctgcatgaatcaaaccgcttacaagcgccgacagcatgtcgttatcaccgaacgtcagctcttcgactgatgtggaatcattctcattaataatcggcacgacgccgcgctccaacagttccattacagtggcataggcatttctgtaccgctctctttttgagaaatcatttcttgttaataaaatttgtgccggcgtcagaccgtatccttttaaatggtccatatattgctgcattaaaagcgtctggccgactgcggcagctgcctgttttccttttatcgtaacgggtcgcgacggatagccgagagcggaaaaacccgctgccaccgcgcctgaggtaatgaggatcacttcatgcccgttttcttttaataaagaaatggcttccgtatgttccttgatttttgcttcatcaatacttccgttactgttggtgagcgagctgctcccgattttcacaacaattctttgttttttcatcgtttctcctccgtggcaatcaatccaaaccggctctcgtcaataaaaaaagcccattccgtcctgaaaaataaggacgaaatgggctttccgtggtaccaccttgtttgaacgcgtttttcacgcgtcccgctttcctgtaacgccaggtatcgcgcctgagttttcccctcaggactccaaggcaggttcggcaggtttcatgcggcaaaatgtttcagcgggccattttgctctctgtcacagaaagttctgcgtactgatcctcttcaacgctcaatgatttttttatattatgcaaagaaaacaggttcttgtcaagacattttcatccataaaaaacagcccgcctccccggcggaccgtcattaattaaatacgatcgttttgtttccgtgaacgatgacacggtcttccagatgccattttacggctcttgccaacacgctccgctcaatcgttctgccgatattcttcagatcctctgcgtgatctctgtgatcgacgcgttcaatatcctgttcaataatcggcccttcgtcaagatcgtccgtcacatagtgagaggtcgcgccgattaatttcactccgcgctcataagcccgtttatacggattagcgccgataaaggccggcagaaatgaatggtggatgttaataatccgattcggatgggcagatacaaaatcagacgtcaaaatctgcatgtagcgggcaagaacgatcacatcaatcttatactgctccagcagctcaagctggcgccgctcaacttcggcgcggatatctttgttagctttcatgtaatggaatggaatattcagcggctcgaccacttctttcgcctcttcatggttgctgatgacgaccgcaatttcggccatcatattgccgctttgccattcccaaatcagttcatgaaggcagtgcagctctttggatacaaagatcgccactcgcttcagctcacttgccagagagaggctccatgtcatgccgaatgtctgggcgattgaggcgaacgcctgctgtaaatcctcttttttctcacgaatgcccttgcagtcgaattcgatcctgagaaaaaaacgtccgccttcagggtcagtcgtatattgatttgattcaataatatttgcgccgtgttcaaacaaaaacgcggaaacagccgatacaattcccggctgatcggggcagctgacaagcaggcgccctttttcctcattaccgcggcggtattctttcagccgctgtgtcatatatgaattcatctgttttaatccctcgtatcttcataattcgtaacttattatagattatactgaaaatttgataaaaatcaatttacgaaagaattttcagccctacggctgcgcacaaaataagcgcaatgaaaaagatgcgcttcgcatccttctgctcgccgtagaaaagaatgccggctagtgcgccgcccgccgtgccgataccggtccagatcgcataggccgtgcccatcgcaatcgtctccatcgcataagaaagcagggaaaaagaagccgcaaatccgacgataatgaaaaaaatccacttgactttcttttctttttgaaattgattcattaaaatgaccccgagcatttcacaaagacccgcggctatcaggctgatccaatgcattacgccttctcctccttcgtctcaggcttatcctgtgtgaccagctttaatccgatgacaccgatcagcaaaacgccgatcagcacgatttttaccggatcggcctgttctttgaaaagcaggatttcactgagcacggtgcccgctgtcccgagtccggtaaagaccgcatataccgttcctacgggcaggctgtccgtcgccttgattaatagataaaaactgatgatgattcccgtaatcgtgccgccccacgtcagtgccgaatcagcatgtttcaggccggtgacccataccacttcaaatacggccgctatgaccactaaaccccatttcatgttcttcatcctttctgtttccgggcaatacaaaaagcccggaatagtcgtctcacatgagattgactctcccgggcttttttccctccgtgtgcatatgcgggatatgtccgcatatgtgttttctctcggaccaggccatgtatgaacatgcggaaccctagaaaacatgtctgttcgtatcatactacatttcgccgaaacgttcaacgtcagatgtgatgtcaaataccgtcagccgcctctcccatttggtaacggtctcaccgggcaccatgccgattttttccgcgacgcggacggaggcagcattttccggatcaatcagcgccgctatgcgtccgtattgctgcgtatgaaaaccgtagtccagacaggcgttcgccgcctctgtcgcatagccgcagccccagcggcagcgggcaaacatatagccgatttccatcaaagtgtttccgcttatcgtctgcggaacgattccgcattgaccgagaaatgcacccgacactttatcctctgcgatccaaagactgacgccgtatcctgcggccaatcgtttgttccaggcaatccattccttcgtttcccgtctgcttttaagagaaggataatatttcatgacctctctgtcggtaaacagcccgtacaaattgtcttcatcgtcatcccgcatagtccgcagacggatacgcccggttgtcaggatggtgccggaagacttatgtttcatcatgcacgccacgtctcctttccctgtaataaattatggacccggcaggaaaagtcctttttcagcataaaaaaaccgcttttaaaaaaagcggtttgacgattaccaaggtttatctgttccgagcgcctcggccagggccttgctgtgttttaagcggttttttcgttctccggcgcgctgaacggccgtattgtgaagcatgatttcttcctcggtttccggcacgatccgcggaacgggcaccgatttcccgtttgaatcgagcgcgacgaatgtcagaaacgacgttgccgcaagctcgcgttcacccgtcatcagatgttctttaatgactttgacaaacacctccatagacgatgtgccgacccatgtgacgtaggattcaagacatacggaatcctgttggccgatcgggcgcaaaaaatccacagaatccattgaggccgtgactgtttcacaccggcagtggcgggccgcggaaattgaagcgatatcatcaatatagctcatcagctttccgccaaacagcgtattgtgattattcgtatcaagcggaaaaaccctgcttgtcttgacaacccttgtttctttgcaaaatcttgattctggcaacttcatattatttaaactcccctttggtgtctggtcgttttgacatttcatctgtaccctattaaacaatactttgatcgttttgtctaaaattttaaatattaagttggttagatattctatcagaaatgtttcattatttatcacatccgggaataataaacgcacattgaataccgataggaggatatcacatggacgtatccatacccaaatccacgcggaaaccggcttgccgcagtgagtttgatgctttgcagacagtcatcttatgccggccggaacacatgaccatcaaggatattattaacggaacgcagaaacatttcaaacaagaaaatattaacatacccgttgccctcaaacagcatagtgagtttattgacattttaagatctcatcagattgaagtcgtcctgctgcctgccgatcccgctttgcctgagcaggtattcacccgggatatcggatttgtcttaggcgagacagcgtttatttcaaacatggcggcttcagtccggcagggagaagaaaaagtgtttcaagacctgcttgacgataagaaaatcccttatacgcgactgaaaaaagcgaacattgaaggcggcgacatcttgatcgcagacggcaccgtttacgccgggctgagcaagcgtacggataaagcggctgtccgggagctgcgggaggcgctgccggagatgactgttgtgccgatccctctcaaggaggatttcttacatttggactgtgtatttaatatgatctcggaaacggaagcgctatactgtaaaaatggcttgcggcagaaagaaattgatcttctcgccgaacgttttgagatgatagaagtgcctgaagaagagcaattcacgctcggcccgaatatcctgtcaatcggcaatcagacaattatcagcctgccgcagcaccgtcatacgaaccgcgagctcagaaaaaggggttatacggtcattgaaaccgagttttccgaaattatcaaatcaggcggttccttccgctgctgcaccttgccgcttgccagaacatcttaaacatttacaaggcagtttccttcaagatacgttaatatagagaagacaagactctaaagggggaaaccgaatggctaagtacataggatacgcgggaacatatacaaaaggcggaagcgaaggcatttattgttttgaacttgatacagaagcgaaaaggctcagccggccgaagctggcagcaaagctcggcaacccgacatacgtcactccgaattctgataacagcatgctgtattccattgaaaaagcagacggaaaaggcggcgtcgcagcctatcagattcatcagaacagcggggaattaacgtttgtaaaccaccagctgattgaaggcccgtctccatgccacgtcagcattgatgataaacatgaatatgtgttaaccgctaattaccacagcggaaaagtgcacgcctttcccgtcaatgaggacggaagtctgcaggagccggctgccgaagccgctcatacgggaacaggtcctcatgaaagacaagagaaaccgcatacccatttcgctggctatacacctgagcataactacattgcagccgtcgatttagggacggatacgctgtatacgtaccaaatgaaaaacggttcgctcacagaggtgaaaactcactctttcgcaccgggttcagggccgcgccacatcgttttccatccggcggaaaaatacgcctatgtcatgacggaaatcagcaatgaagtcatcgcgcttgaatacaacccgaccttaggtgaattcagagagctgcaggtcatttccgctttgcctgaaggctttacggacaaatcgcaaggcagcgcaatccgcatatctaaagacggcagatttctttatgccgccaaccgcggacatgacagcatcgccatctttaagatcaaccaatattccggtgaattgtctcttattgaatgggtgccgacagaaggcaactggccgcgtgatttcgcgtttgacccttccgagacattccttgtcgcgtcaaacgaagaaacgggaaatctggttttgtttgaacgtgatccggaaacaggcaaattgactctgcttcaatccgacattccggttccgtatccggtctgcgtgtcatttctgcatcagatttaatcaaaaagaaagctgactttatattgtcagctttcttttttgtataaatggcaggcgacaaaacgccccgccttcacttcttcaagctcaggcgttatcttaccgcagagctccatcgcttcagggcaccgcgtcctgaatacacagccgctcggcgggttaagggggctcggcagctcccctttcagaataatccgttcacgcttgtcctcaagaagcggatcaggaatcgggattgaggataaaagcgccttcgtataagggtgaagcggttcccggtaaagcgcagcgctttctgtaatttccatcatgcggcccaaatacatcacgccgatccggtcgctgatatgcttgaccattgataaatcgtgggcgataaataaaaatgtcagccctttctctttctgaagcctttttaataggttgacgacctgagcctgtaccgacacatccagcgcggaaatcggctcatccgccacgataaattcgggatgcagagagagcgctctggcaatcccgattctttgcctctgtccgccgctgaattcgtggggataccggctgccgaaatccggatggagcccgacagcttcaagcagttcatccgccatcatcatacgggcttttcttgtattgtaaagattgtggatttccatcggctccataataatttcccttacggtcagacgcggatttaacgaggcgtaagggtcttggaaaatcatctgcagcttgcggaagaagaccgaccgctgttcggccgcggcacggtgtatatccgtcccttcatatgataccgaaccggccgtcgggtcatacagacggagaataactcttccgagcgtcgatttaccgcatcccgattctccgacaagtccgaatgtttcccctcttttaatgtgaaagctgacaccgtcgactgcttttacggctttctttcttcctgcgtcaaaatgcattttcagcccgctgacttcaaggagcggagatgccgtcattttctattcccccttttcgcttatacagcggcgtacggtgcataattctttttcatagatcgttccttccaaggacagcacttcgattgtttttcccgttttcggggagtgcagcattcggccgtctcccagcgccaaaccgacatggtgaatcgcgccttttccttcttcataggcgaaaaacaaaaggtcagccggccggatatcgtttaccgccgcgccgcacccggcttttgcttggtcctttgcatcacggggaagggtatagccgtttgctttaaatatcgaatacataaacccggaacagtcaaacccgaaaccgctcagtcctccccataagtacggaagcccgagaaacatcatgcccgtttcgatgacctcggccgcccgtccttccgtatgccggcactcgtctgcgtcagcttcatttacgaaccgttctccgagaggcgtcacaacccgaaaaaagcctttctcacgtcctgatgccggaagacgcgttaagaaacttacttccaagtccggttcgccgttagtgtgatataaaaaagctgtcggtttggtaatccatacggcgggcgaagatgaaaaaaagccgtcttttgaaagctggcttttttttatccagcccggatatccgcgcgcatccttgtttgagggctggccgggaacggcgacaaaagcccattccccttcctctttgagaatgatcacctcttccccgaaaagcgcttgcgtttggacaaggttgtctgtgcataattgcagccgctcttcatatcccatagacgctaaccattttctgatctgcggcgggttttcaagcatcggcgcatcatacgaacggggagatgacggcatcgtccatacgttggctgccgccgctgtaacggctgctctcatcttttcgcctcctcttgtttcgacaccccggtaatgccgagacccggttcatcgggaatcgtaatctgactgccgctgtatgtgatgccgcctttaatcaaatcatctttcagcataagcggcgcatcaaaatcaaaccttgtcacattccgtttgcccgcggcaaaatgagccgcggcggtgatgccgagcttggtctcaatcatgctgccgaccatgcattccacgccgcacgtttcggccatcgcattgattgtttccgcctgctttatgccgcccgctttcatcagcttaatattgattaaatcggcgcttctcgtctgcagcacgcaaaaggcctgacggggagtaaagacgctctcatccgccataatcggcgtgtctacggcatcggtgacctgcttcagcccggcgatatcgtctttatgaacaggctgctcgaccagctcaatgccgaggccggcgtcttccatctttcggatcgcagtcacggcttctttcggcgtccagccttggttggcgtccaatctcagtttgacgtttccgccgacacgtgatctgatcgcctgaatccgggcaacatcgtccgatatgtcacctatgccgacttttatctttaaaatatgaaatcctttgttcacatagcggtctgcatcccccgccatctcctcaggagaattgacgctgacggtaaaatctgtttccagtgtattccgatagcctccgagaagccggtaaagcggctgtccgtgcatttgcgcccatccgtcatatacagccatatccaccgcggcttttgcgctttgatttctttccaacagccggctgatatcatacaaaacagcttctatgccggaaaggctccgccccaagagagcgggcttcagcacatcgcggacggcgctttcaataccgtccgtgctgtcgcctgtaatgacaaccgtcggcggcgcctcgccccagccggtcagaccgttgtcaaatgtgagcttcacaatgaccgattcagcattgtaaaccgtgcgcaaagcggtcttaaacggctttttcagcggcacggacatccgtcccgtttgaatatctgtaatcctcacgcctgatcactcccttccggaaacccccgattcaatcgttaccgctttggccgccgtatccataaccgcgcgggctccgatcggaacggcgaagctcggtgaacaatggccgattttaaagcctttgagcgcgggcttccctgatttgacaatgtaatcgttcagcacttgctctaaagtaagcgacttttctttatgcttcggttcgcattggtgaaaatcacagaccagtattccggctgcgtctgacagttttccggccatctttaattgattcagcatcctgtcgatttgatacggctcctcatcaatatcctcgataaacagcaatttgtctttcgtatcaatttcaaacggcgtgccgagtgtggacgtaatgagcgacagattgccgcccgcaagctctccctcggcccttccgcctgtcagcacctccagcggagaaatgtcctccgtataggtgaattccgtttctgtaaaaagctgatgatacgacgcttttgtcaggggttcagcatcttcaagcccgacatccgtgctcagcatcgggccgtgaaatgtgacgagccccgtattttgatgaatggcggtatgtaaaaacgtaatatcgctgtatccccagaaaattttcggattgcggcggattaagccgaaatcgatgtcggcggcaatgcggcccgtgccgaatcctccgcacgcgcatatcaccgctttgacattctgatcactaaacatgtcatggagatcattgaggcgcgcccggtcttctcccgccaaatagccgtgacgggtcttcagcgcccggccgagtttcacttgaaggccaagctcattctctaaaaacagcagcgcggtttgcagcgtcccgctctcaggcgggcttgcgggtgcaatcacaccgaccgtgtcgcctttttgcagtgctttcggtttatggttcatgactttttcaatctcctttccggattgaaaagtgaaacacgccgctcctttaacggcaaaagagcggcatatgtttccgctgtaagatcaggacttttccgcccatttcagatcaatgtaaccgacggggtgccggacaatgcccttcacgccgctgttctgcagatgcacctgattgtaaaagtaaatcggaatgatcggagcctcgttcatgagcagcttttccgctttatgcatgagcgcaaaacgttttttggcatcggcttcctgttttgcctgcttgatgcagccgtcgtatgccgcgcttccccagccggtgcggttcatggaattatccgtttggaaagcctcaagaaaactgatcggatctgcgtaatccggtaaaaatgagctttgagagaactggaacttcagtcctttctgctcttctaaaaagacgttccattccatattggcgagcttaacgtctataccgagcacacttttgagcttctgctgaatcgcttccgctattttcttatgctccggttttgtgctgtatgtcaatgtaacggcgggcagcttgtcataatgctcttctgccatgcctttttccagcagttttttggcttctgattcatccggagttagtaaactgccgcccgcttcgcggaaatctttcccgtcaggctgagtaaatcccggggatacaaaggcatgtgccggcttttcactgtttttggtcacataatccgtgatttctttctgatcaatcgctgccgcgaacgcttttctgatcttttcattttgaaacggctccattttaacgttaaaacgatagaaatagagtccggcctgatcccacgtgcggacattttttcctcccatcagctgctcgctcagctctgccggcacaaaggcggtatccaaatcccccgactggaacatctgatagtcggtattccggtcactgaccatcgcccatgtcactttatccagtttcaccgtctttttatcccaatacgtctcgtttttgaccatcgtcatgctgtcgtcatgcttccattccgtcagtttgaacggcccgttgccgacaaaagtttttgcttcagtgaaccatttcgcatcagccttggcgaccttctcattaatcgggaaatacgccggattggacacgacgctcaaaaaataatcctgcggggccgccaatgtgacgacaagcgtttttttatcctttgccgtgactttcacgtcttcttttttgccttttccgctgttaaattcttctccgcctttgatcatatagccgagaaaagcggaagatgcgcccgttttcggatcgagcatccgcttccaggcgtacacgaagtcttccgccgtgacgggatcgccatttgtccattcggcgttatctcggatattgaaggtatatgtcagcttatcagcggacaccttccagctttccgccatggccggttcgggcttattatcttttccgagcctcgtcaatccttccatgatgttattcagcggctgccaggaaacattattaaatccgatcggcggatcaagtgaggtcggctcattttcgttattgagccgcagcaccgtctctcccccctgttcttttgctttgccgggttctgtccccgcctgttcattggctgtacagcccatcagagcaaacgaaacaacagcaatcacaccaatcgcccatctctttttcatttcaatccccctttttcctctgctgcagtcagctgctgcttcagccgctctgcacggtgatcctgaagccagcagctgacgatacggcttttggatttcacggttgttgccgggtataccttttcacagacgatcatcctgtccgggcagcgggcggcaaacgggcagcccggcggcggatcgaataaatcaggcggcgtcccgtcaatcggcgaaagctcactatcttccatatccagccgcggcactgaacgaagcagcccctttgtgtatggatgagccggacggtaaaaaatatcatgcctcgtgccgatttcggcgattttccccgcatacataacggcgactctgtcggcggtctgagcgacgacgccgagatcgtgggtgatcagaataatagacacgcctgtttttctttgaatcttcttaaataattcaaggatttgtgcttgaattgtcacatcaagagccgttgtcggttcatcggcgatcataatttccggctcgcagatcagagccatcgcgatcacgatccgctgccgcatgcccccgcttaattggtgggggtactgcttcaggcgggatttcgagtccgggataccgaccagatccagcatggcgagaacctcggattcagcttgttttcttgtcatggcgcggtgttccaacagcgcttctgagagctgatcccctatggtcaaagtcggattgagcgccgtcatcgggtcctgaaaaatcatagaaatatcgctcccccggattccccgcatttcccgatccgacattcggcaaaggtctttctgtttaaattgtatgcttccggattcaatctttgccgaatgtttcggaagaagacccatcacggcttgtgacgtcacgctttttccgcatcccgattcaccgacgatcgcaaacgtttcacctttatataaatcgaagctgacgcctcttacggcttttacagtgcctccgtatgttgaaaaagtaacatgcagattttgaacggaaagaacttgctgcgccatttttcctacctcctcagtttcgggtctaacgcgtcctgcaagccgtctccaagcacgttaaacgcgtacatcgttaaggaaatgaaaaaagcgggaaaaaacagccgccaccaatggcctgataaaatcgccggcagcccgtcatttgccatgactccccagcttgcaaacggcgcctgaatgccgagtccgagaaaacttaaaaatgattccgcaaaaatcgccgccggcaccgtcagcgtcatttggacaataatggctcccatcgtattcggcagcagatttttcttaatgatccgaaatgttttcgctccaaacgttttcgatgccaatacgtgttcatcatgcttcatcctcagcacctgccctctcacaatccgcgccatgccgacccatcccgtcactgtcagagcgacgataatggaactgagccccggccccatcagcaccattaacaaaatgacaacgagcagataaggcaaaccgtagagaacctcgatgattctcatcatggcgctgtctgtccggccccctttgtagcccgcgacgcctccgtagataacgccgatcaaaaagtcgatcagcgccgccatcacaccgacaaataaagagatcctcgctccgtaccacgttcttgtaaacacgtcccggccaagttcatcggttccgaaccagtgtgaaaaagaaggcggaagattctgctcggcgagcgtctgccttgtcacgctgtgcggtgatatcagcgggccgaacacagccgatagaaacaggcagcataatatcacaagtccggccatcgccaatttgttctttttaagccgccgccacgcatcctgactgtaagacaggctcggacgcttgaccgactcggtttcaccctttctttccgcgcccggctgaaaccagtcatcaggcacttctgtgtgttttaccgtttcttgcgggagattcatcaggatcaccctttcttatgaagttttatgcgcgggtctaacaggccgtatgccaaatcaaccagaaacagcaggacgatcagaatcacactgtaaaatacggtcgttcccatgatgaccgggtaatcgcgctgattgatgctttctacgaaatatttgcccattcccggtatggcaaaaattttctcgatgacgaaactgcccgttaaaatacttgcggcaagcgtcccgagtactgtcacaacaggcataagtgcgtttttcaatgcgtgtttgatcacaattttgacgggagaaagcccctttgcttttgccgtgcggatgtaatcctgagtcagcacttcggccatgcttgatcttgtcagccgcgcgataatggccatgggaccgacggcaagcgcaacagtcggcagaaccatgtgaacgggactcgtccaggtagctgccggaaaccatttcagatgaaccgcaaattgctgaatcagcagcgtagccattataaaattcggaatggaaatcccgagcaccgcaaggctcatggccgcataatcgagaaagccgccgcgcctgagagcggccgttatgccgagcgcgagtccggaaatcacagcgatgatgatcgccgttatcccaagctcgaaggagacgggaaatccgcgttcaagcatggcgtttacactgtctgacggttttttgattgaaggaccgaaatcaaaggtaagaatggattttagatagatggcgtattgagtgataagaggttcgttcagatggtagtaggattcaagatttcgctggaccgcttcgtttgtgccccgctcttcgttaaaaggcgagccgggtatcactttcatcatgacaaatgtcagagtggtgatgacgaggacggtcataatcatggcgataaaacgtttgataaaataccgcagcaatgccgttcacccctttaacagaatgttgttctcatagcgagttctgtcatgacgagcatggcctgataggcttccggcatgtcttttgcctgaaattgaacgattgtcgttcccgggatgatttctgtgcccggcattaaatgggcccattcagcctgtccgtaattggcaaattcaatgcctaatacaggtttttcaggcggagtcagcggtttgaccttatctttatttttgagcgcataggctgttttttccgtcaggagccgtccggctttttgaggggacaggcatttgaccgcggttcttgaaatggtttgtttgacggcggcagtcgtcacattcgggatcagctcctccgcctcttttgcggcgcaatcatctccggcagccatgatgaccgggacatcgtaaaatccggcgagataggcatttaaccccagttcaccgacaggcttatcatttatgtaaaagtggcggacgccgaatatcatgctgtgcgacatgacgcccggcatcgacgctctcgcatgatagccgataaacatcacacctgaatacgattcatcaagcccctgcatcatggaaaacggcttgacatcccccgtaatcagctctgcctcagggtgaagtttttccgcgagcagattattcatctttgagtggctgtcattcacggtcacttccgtgcatccgttattaaacgcttctgcgatgcaccagtttgcttcttcggtcatcagaaccctgccgcgctcataattgtgcatgctggaattgacaaatgtttcatcaggcagtccggaaatcccttccatatccacagatagatacagtttcatgtaatgcctccttttttatttaaaatttcgatattaaattatgaatattctaacaaattatattaaaaaaggatgaaacatgcaatataccattctgccattatgggaaaaaacaaacccttttcaccgggaaaagggtttgctgatagaaaaagttacataccgtttttgtttatagggtgaccccgaaactgtctgaccgcacttctgtattcgcgatcgggaatgacctgatgcctgatcggtccaggagcctgcggcgaaggcttttcatccgcctgcttacggacggcatgcggtttatgcgccagcttatgtcccatgccggtcgcattcatgacaaatgataaacacactaaaagcaagcttaagatgaaagcaataagaaacaaatcgctgtatgtccccatcagcaggtcatgcggcgattgtgtgccgcgcgcgccccgaagcatgccggaagcatctcttttcgtaaaataccctattaaaacaggtgcgcccatataaatgaacagccttaaaaactgaacggccgtcatgcgtttcaccagttccggaagcggtccgcccaacgcggcgcccatcagtccggctgctacgataagccctgtcccggccgccagcatcacgaaaagcgccgcaaatagaataaacggtatatgatgacccgccgtcatccattggaaattcacgaacaccagtataacagagcctgttatgccgagcatgcccggaccgactttatcatatgctaatgcactgataacagcggcgatggccacgcctcccaaaaggctcgcatataagaatatcagttgagtttgtgacatgtgatatgcggtctgaagctccccgtgaaatgcagaaagactgaccgctatggaaatactgcccgcagcgatcatgaaaacacccaaaatcggctttggaatcagcataagtttaatcgaaatcagcgcatgttcgtttctgtactgcataatcagcaggatcagcagaatgacgatgcttcctccaaatcccgccaatgtctgccatgatgaaaagccccatttcggcagatgaataaaagtataggcggtcagcacggctgatccacccgctaacagaaaaccgatgccgtcaaatggagatttttcagtatttttatgagcgtcatcccgcagccacatataactgaaaatgaggccgaaaaaagacagcaggccaaaaatgccgaacagccaatgccaatggccggcgcttgccgccgccgtgcctaaaacggtccccataatgacggacccgtaaaatccgccgattaacacaaataaggcgtaattccggcgttcaatcggaaacgaaagcaccagcatcggaatcataatcatcagcatagtgcccgccgcagctccctgtaaaaaacggcccgcggcgagcggataaatatcatttgtcacagcagcaagcagcgctccgatgacacccgcggccatcgaaatcatatagacaggccgggagccgaatctttttcttaaatacggccccgccggcacgaataaggcaaatgccatattaccgataataatcggatgaaaagagtcaaagttttccccgccgaccgtctgccggacaaggctttggacagccgaaagagcggtattcgacatcagccccggcccgacagccagcacagcaagcagagaaatgatccagtgatgtttttctttcatttgacagctcctttcttaactatttgacaaagtgaaaaagctaacagatttcccccattagcttgacagaattttttatatcttttcatgtgaaggattgaacataatatcccatttattatttcaaatccgatggaaattgtcaatataaagcgccgccgtccgatttcgtctttttcacaatttcccacaatcttttcattattatcccacactttttgtttaagatggagtcagtaataataggcaaatcatgctatgatgaaatagagaaacggagtgaacatgatggataactatcgtgatgaaaatcggacagaccaaaaagaacaggaagtccttttagtaaaagaaaacccgcagccggccggatattccgagccggacgaggacaagaaaaaacgaagcttcggctggttcagaccgcttctcggcggagtgatcggcggagggctcgccctcggcatctatacatttacgccgcttggagaccatcagactcaagatacttccaatccggctcccgctcaggaaacgtcatcggtaaccgccaagcagacatcttttgaatcagacagcggcaaatcggcaaacagctcatcggcaaattcaagcagcatttcgaatatggtggaagacatttcaccggcgatcgtcggaatcaccaatctgcagaagcagcaaagcagttccgatttattcggattcggatcaagctcggattcaaactctaatgcatcgggtgatgatgcggaaacgggatcgggttcaggcgttatttttaagaaagcaaacggcaaagcgtatatcattacgaataaccacgtggtcgaaggcgcctcttcccttaaagtgtcattatatgacggcaccgatgtaacagctaaactcgtcggccgtgattcgctgacggacttggccgtattagaaatcagtgataaacacgtaacaaaaacggcaagcttcggcagttcatccgctctcagaacgggtgaatccgtcatcgccatcggtgatccgctcggaaaagacctttcccgcaccgtcacacagggcatcgtgagcggcttaaacagaaccgtctcgatctctacgtcagccggtgagtcaagcatcaacgtcatccaaaccgatgccgccatcaatcccggaaacagcggcggaccgctcttgaatacagaaggcaaaatcatcggcatcaacagcatgaaaatcagtgaaaatgatgtagaaggcatcggctttgcgattccgagcaacgatgtaaaaccgattgccgaagagcttctcacgaaaggacaggtggagcgcccttatatcggcgtgagcatgatcgacttggaacaagtgccgcaaaactatcaggaaggcacactcggcctcttcggcaaacagctgaataaaggcgtttatattcgtgaagtggcgcagggatcacctgcagccaaagccggattaaaagcagaagacatcattatcagcttaaaagggaaagaaactgacacgggcagcgaacttcgcaatattctctacaaaaatacgaaagtcggcagcaccgttgacgtgaaaattatcagaaatggcaaggaaatgacgaaaaaaatgaaactgactcaaaaagaagaaacatcttcttaacaaaaatccaaggcagccgccttggattttttatatacagatgaaactttaggcctggatcagccgtatgactcagtgtacaaaggaggatacatacacatgaaacaaaccggacttttgctggtcgttaccggcctgatcttgctgcagctgagcattcagcttcctcagcaaaacgctgcttggggaatgacgcttggtgcaagcattttactgaaatttttcgtgaaccggactgatcatgcgctctctgcacacccagaccggccgcagatgaataaaaaaagccgcgggacattctgtcatcccgcggcttttattttacataaaagcaccctgtccgctggccggacagggtgtttgttaagacatatgctggtcccgataaatcttttcgtttttcataccgtacgctttttgcacgatatagagcggacgatcttttgcttcgtcataaattcttccgatatattcgccgatcattccgagcattaatagaacgatgccgctgaataacagctgtatcacaatcagagaggaccagcccgtaatggtgctgtctgtaaaaagcttcatgtataaaacgataaacatatagagaaaacccgctccggacatgagcattcccgcatagcttgccgccttgagcggtttatgagagaacgttgtgatcccgtccatggaaagcttcagcatttttttaagcgggtatttcgtttcccccgcaagccgctcatctcgttcatattctacagcagtctgcttaaagccgacccagctgacgagtcctctgacaaaaggatttttttcttttaatcttttcatctcatcacagacttttctgtccagcaggcggaaatccccggtgtcgagcggaatatcaatatcagtcacgctccgcagcagccggtaaaacagagaagccgtctgtttcttgaaaaaggtttctccctttcgtttcgttctgacggcgtacaccacatcgtagccttctttccactgctcaatcatatcaaggattaattcaggagggtcctgcaaatcggcgtcaatgacggcgattgcattcccctctgcataatccatacccgctgtgatcgcgatctgatgtccgaagtttctggaaaaatcaataattttcactctcggatcaatcagactttgctctcttaaaatctcaatactgcggtctttgctcccatcattgacaaagatcaattcataatgctcttttgtttgatccatgacttctttcaggcgctgataggttgtctgaatgacgagttcctcgttataaaccgggacgactattgaatattgaatatgtctgctcatgttttttcctcctattcatcagattgaagttcgtatagtgaagctgactgattcattccgcccggcccgccgctcattcggctgtttttacccgcggccttgctgctttttgtatcagctgcatcatgatttttcgttttctgatctgtgcttgattgccatttgtatgaagatactttctttccggttttctcaacccattcaacaatatcgttgtttccgcctttgcccattccggatgttaagaagtattttactttcccttcttttacgagctttttaaattgagtcagcgtaatggccgggtcagacccgctgaatccgccgatcgccatgaccgcttttttcgtttttataatgtaaggcgccgctgtgttggaatcggttgcagcaaatagataatccgctccggcgttatgtttctctaaatagttgatcagttttgtattgacagatgcgttatccattcccatgccttttccgcctgctgacgcaagctgagggcctgtttcaggcaatgagctgttgcctccgtacagaagcggtgtgctcgcccaataaatcggcatcaccatcaagacgagaagggctgcaagtgaaacatagtaactgagcggtttttggcgctgtttgaatacgaacagggcgattgccgccactgcaccgagaacgcctgctccgatgctccagcctgcgccgatttgatcattgtagtttttaaggataaacagctcaaatccggtagtcacaagaatagcggccggcaatagccaagttttccatcccgcctgcttgcggtacagatgaacgagggcgacccatcccgcaccggtaagagcagcaatcggaggcgccagcataatgagataataatggtggaaaaattccgccacactgaagaatccggcaatcggcacaagccacgctgcccaaaagatcgtttccttctgttctgctgataatcttcttctttctctcgccccggcgatcaataaaccggccaatccaaaaatcgcaaacggcaggagccagctgatctgatcagataattcttgttggaagagtctcagcggaccgggtgttcccgtaccgaacattcctgaccctgactgcattttcgagccggtgcctgtaccgctttttcctccgccaggaccgcctttgccgccgtctccgccgcttggagggcctccttgaccgccgcttggcatttgtccgttagatggaggtgccgtcatactgccggtttgtgatttgtctccgcttgctgactggccggccggtttttgcatttgtgaagaaccgccggaagaagacatccctttcgatgcgtttccgtcgggcccgccctggccgccgccggaactttgccccgtcagccgctgaatcccgttatatccgaaagccaattccaatacggagtttgtctggctgcttccgacatatggccttttgccggcaggaatattgtcaacaatgagcggccatgacaatgaaacggctgctaatacggccagcgcgcttaccagtgaaatgatttttttcttaatcgcggtatttgccgccatcatatagaacagcaagaaggccggtaagatcatataagcctgaagcatttttgtgttaaagcctactccgacgacaaaaaatgccgccaaaagccagatcagttttccttttcgaatcgctttaaagagaagccatgtggcgaacaagaggaaaaagaccagtaaagcatcgacattgtttgtgcgcgctacggctacagcaatcggtgtacacgccatgacaaacgaagcgatgcgcgccgccgtttttccgaacgtcggctttattaataagtacatgaatagaactgaacctacccccgccaatgcctgaggcaggatgacactccacccgtgcataccgaatatcagcgcgctgatcgtttgaatctggtatgtaacaggcggtttatctaccgtgataaatccggctgcgtcaaatgaagcgtaaaagaaattatgaaagctttgaagcatactcgttaccgctgcggtgtaataaggattcaccgtatcgtcattccagatgttgtacatattcaagaatgcggaagcgagtaaaataaggattaagactgcgtctatctcgcgttttttcattttcacctgtgttttcactccttttgtttaactttgaacaagtgtaacaaccaaatgtgaaaaatttattaataaacaaagacatttattttgccgtttacaaataggtaaaaagaatgacaaaacgggtaaaaaagcaaaaaaaaagatgcccccgtcaagccggaaggcatctttcattacttctgatttactgaatcggtttcagccgcgcttctatttcagaacggcggtgttcgagataaggcgggagcgcaaccgttttgcctagctcttcaggtttttcatcaaccataaatcccggaccgtccgttgacaattcaaacagaattccgttcggttcccggaagtacagcgctttgaaataataacgctctacaatgcctgagttgctgaaaccttctttcgtaatgatgcggtgccataaagcaagctcctcctcattctgaacacggaaggccacatggtgcacgctgccttttccaggacgctcgcgcggaagatcgtttctttcaatgagatggacttctgtacgcgcgccaccgtttccggattcgagcaccgtaaccgcgccccggtcttcatgtgtttctttcccgatttcagtgaagcccagcacatcggttaacacacgcagcgtcggttctgcatacgggacggtcaattcaacgggcccaagaccgcggaaagaatattcttccggtatgccgctttgcttcaccgcttcaccgatgtcttttcctttttcgtcagctgtcagcacaagccgctgtccttcatgatcctgaaaagcgagtgtgtccctgcccgctattttcacgatctcaccgtgagagacctgatgctcttcaaatcgttttttccaatattgaagcgcttgtgcatccggaacacgcaggccgattgaagaaatactgtttgtccccgcatggaacggcgcgatccgcggaatctcgaaaaacgtcaattccgatcccggattggctgattcatcaccgtaaaataagtgatacatcgtcggttcatcctggtttaccgattttttcacaagcttcagccccaggatatttcgataaaaatctaaatttttctgcgcatcagccgtcaatgctgatacatggtgtattccattaactttcattatgttatcctccagtcaattatctcgatttcgagatattttatatatacaatttatgttatccggatcgtaaagtcaacccatctgcttcacagacggtctgcagactgccgctctcaaaataacgaacttttgatattaaaaaaccattaatgttcgcttttaaaacagtattttttccttctcaaaagcataaacctttatcttttaggcaaaacaccaaaatcagaaaatttattttattcgtgtttcagcaattagggtttacaatatggaaaatagttttttcagcataacgattttacatctggagggaaaggatatgcagattgaagagaatggacttaaaaaagagatcggccttaccatcgccctctcacttgttatcggcaccatcatcggttccggcgtatttatgaaaccaggcgccgtgcttgcctactccggtgatgcgaaaaccgcgcttatcgcgtggctgttaggaggcattttgacgcttgccggcggcttgaccgttgcggaaatcggcactcagattccgaaaacgggcggactttatacatatctggaagaagtgtacggcgaattttggggctttttgtgcggatgggttcaaattatcatttacggccccgccattatcggagcaatcggcttgtatttcggctctttgatggcgcacttgttcaattgggattccggctggtctaaattaatcgggatttcagccgttttatttttaagcatcattaacattatcggaacgaaatatggcggcatcgtacagggaattacgactgtcggcaaattgattccgattatctgcatgatcgtgttcggcctttggaaaggcgatcagcatattttcacagccgtcacaagcagcatgtcggaaatgaatttcggcgccgccatactggccaccttgtttgcttatgacggatggattctgcttgcggcactcggcggcgaaatgaaaaatccggaaaagctgctcccaagagcgatgacgggcggactcttggtcgtcaccgccatttatcttttcattaactttgcgctgctgcacattcttcctgcgaccgacatcgtcaaactcggtgaaaatgcgaccggcaccgctgccggaatgctgtttggcgacatcgggggaaaattgatcagcgtcggaatcatcgtcagcatcttcggctgtttaaacggaaagattctcgcttttccgcgtgtctcgtttgcgatggcggaacggaaacagctgccgtttgccggacagatttcgcgggtgcatccgacattccgcaccccgtggattgccgtgtcatttcagatcgcgctggccattattttcatgatcgccagcaatcccgataagctgtctgagatctctattttcatgatttatattttttacgtcatggcttttttcgccgtgtttatcctcagaaaaaaaagcggcggaaaaccgcgcgcctacagcgtgcctttgtatccgatcattcctgttttggccatcgcgggttcactgtttgtgctgatcagcacgatcattacagatacactgagctgcgcgctgtccctcttgatcggcctcgccgggctgccgctttatttttggctgaaaaacggcagaaaaaactgacaaaaacggttccttttacgggagccgttttttttctggcaaaatcacgtgcaaaagttgacagcaaattcacatcttttgttatactttttaagcaagatgtctgaattcgaagtatgttacgtttttttggcgaagtgggtaacataagaaaaacaggatgagacacgtttttacgaaaaaatcaagaggcgtttttttcgactttatctgttttttttcgacaaaaggctatataataatttgatgtgtgcattgtctcattcaaacaatggagggtttttaatgataaaaagaaaaaaagataagttctcactccttttaacagaaatcgcaaaaaacatagacgaaaccgcagaatactttgtcaactttaaagtgacgaaccagacgactttaaaggaatttgccgatacgttaaaagagtttgaaacaaaaggagataatcatgttcatgtcatgattaaagagctgaacaaagcttttatcactcccattgaacgtgaagacatccttgagctgacaaacagcctcgatgacgtgcttgacggaatcgaacatttttcagcaatgatggagattttctcgatcacttcttcagatgagcatatcgataagttcagcggatacatcagagagtgcgcgaaggaaattttaatcacgattgagctgcttgcagaaaaccgattgaaggacattcaccctcacgccattaaaattaaggaatacgagcacagctgtgataacctgcaccgtaaatcattaaaaaatctgttcggcacagaaaccgatccgattaaagtgattcagtaccgcgagatttacgaaacgcttgaggaaattgccgactcttgccaaagcgttgccaataaccttgaaaccattattatgaaaaacgcgtaacgagggttataatggatactctattacttttaacgatattaattgtcatatgcgctttggtatttgacttcattaacggatttcacgataccgcaaacgcaatcgccacctcagtttcgacaaaagcgctgaagccgcggcacgcaatcgtcatggccgccatcatgaactttctcggagcgatgacatttaccggtgtggcgaaaaccattacgaaggacattgtgaatccttatacattagacaacgggtcagttgtcattctggcggctctactcgccgcaatcgcctggaacttgatcacatggtatttcggcattccgagcagctcttcacatgcgattatcggagcgatcgccggagcggccattgcagcgtcaggttttgcgacgcttaattataaagggttcattaagattatcgaagcacttattttatcgccgattatcgcctttgttctcggctttatcgtatattcgatcgtgaagctgatttttaaagacagcaatctggcgaaaacaaataaacgcttccgcagagtgcagattttgacggctgccattcaatcctatacacacggaacaaacgacgcgcaaaaagcgatgggtatcattacgatggcgcttatgacggccaatttacataaaagtgatgccattcctttttgggtgcagctctcttgcgccctggcaatgggtctcggcacatccatcggcggctggaaaatcattaaaaccgtcggcggaaaaattatgaaaatccgtccggtaaacggcgtatctgccgacttaaccggcgcagccattattttcggggccacgtttattcatctccctgtcagcacgacgcacgtcatttcgtcttccattctcggtgtgggcgcttcccaccgcgtaaaaggcgtaaactggggaacggctaaacggatgcttattacatgggtcatcaccctgccgattgcaggtacactcggcgccatcgcctttttcatcttagatctctttttctgatgacatccgcttctttacagaagcggttttttttgtgacaggaaaatgatgtcatgacatagaatgaacatagcagaccatttttcgaattgtgagggatgctcatgcttttgttttttcagatcatggtgtggacgatggcggccgcactcattttatatgtgtacgcatcctggcggtatgaagcaaaggtaaaagaaaaaatgtttgccatccgtaaaacgtggtatttactatttgtagtaggcgccatggtctattggacatatgatcccgaatcgctctttgccgcatggagacaatatttgattgttgccgtctgctttgcccttattgatgcgtttatctttttgagcgcgtatatcaaaaagctcgccggcaatgaattagagacggatacgcgggaaattttagaagaaaataacgaaatgcttcactcctatcttgaaaaactgaaaacctatcaatatctgttgaaaaatgaaccgatccatgtatattatggaagtacagaagcttatgcggaaggcatcagcagactgctggccgcttatggagaaaaaatgaatgtcacggcttccttgtgcgactattccgcacaatcggataaggaccgcttgacggagcatatgcctgatgcggcggacgttcagtcccgtcttaaccgtaaagacgtctactatgatcaaaaaggcaggcttgtgcttattccgtttacagtccaggaccgccattacgtgatcaaactcacgtcggaaaacctgttgacggaattcgattatttgcttttcacatcgctaacgagcatttatgatttaatgctgccaatagaagaggaaggtgacggttaaatggagcaggcatttcaaaacgggcagccggaacaaagagcgaaaccgttcaaaatgtttaaaaaacgttcaatgacaagtatcgcaagttaccaggtcagccctcataccgccagaattttcaaagaaaacgagcggctgattgacaagtataaacaaaaaaaagcttgattacactaaggacaggagacacggctcttgtccttattccttttttccatatctttcatataataaaaccaacaaagagatgcgacaggtgatgatgtgaagaaaattgtcagacgcgtaaagtttgtggattacggacgcttcgggctttccgcttattcgctgaggatgcgggcgaggaatctcgggttattgaaccggttaaaaaagaaaaaaggctgaatcccgcaatgtgaacgggactcagctttttttgttaaagctgcatcagaattttcgcttttacagcgggaccgtagacgccgtcagacgtcagtccgtttacagattggaagcgggccacggcatctgccgttttcggaccgtagataccgtcaatgccgttattgacagctcctttttcaggatagaaataaagcgcggcgagcgcgttctgcacctggtataccttttcaccggacgtgtacggctctgtcagcttgatcacctcgtccggaagagaatacagtgcttcaaccggcgggctgacgatcagcacttgtccgactttaatcaagttcgggtcagcgatgttattccatttctgcagatcggccacgctgacgccgaatttccgcgcgatcgccgacagtgtatctcctttttggacggtatacgtctgtctttcctcagaaccgattcccgctttaaactcatcccatgtatccagcagtcttctcggacaaagctttcctgaccaatgcttgtgcgcaacgacattcgcaagcgggatgccgtgcgacgtcattaatgtgcggatgagccattgggcgtttgccacggcctgtgaaaagttgccgtctgcgttttcacaaatttcaataccgatggatttacggttgccgtccccgtttccgtcaccggcatgccagccgttttcgttcagcggaagatgctgataaatttccgtatcatcgactgtgaaatgccagcttgtcggtgtatcgggatttttcacatagcttgcgtgacttttggcgttagctccgactgcggtattggctgtattgtgcaccgtaatgtaaatcggtgtcattgcatagcctgggcggttattgtttcctgccgggataaaatcctgtgtgatttttaccatattctcatctctcctatttcgataaattgtttatttttaataaagcctgctgttttttcccttttgctgtaacataattgtttttaaaccaggcggcggcagtcgttatgattgtaaaaacggccgacccggcggcatacagcgtatctgcaagctggctgacctggtcctcctgaatattcagcggcgatttgccgaacatcagcaaagtttgattcaataaagcaagcaaaagaagcaccgtcctgacgaccgtgcctttgtccgcgaatttcatatcggtttcccccttacttttgcagcagattgtacatgatggcgattgctccgccaatgacgcccgtgcagattgctgtcacgatcgctcctgtaatggtccgcttaatccatgttgtgttttcgtcaattttgttcagtttttcattcagcgtcatgatttgctgatcctgccggtctgatacccgctctaatgcggctacccgctgttcaagcaccttttgttcacctttgatgtctgcgaattctttttgcaccgcttgttcatccagaagcacttccgctccctcctcttacattgttctcacctcccttcggaagcttcattcttaagaaaatgccgtgcctttgacagaaaggctcccgccggaaatgctcttgatttccatgacgatttccttaaagccggcaatatcaaatgaccacacttcttctgtgcctgacgtaccggcggctgatgtcccgtcatcagacctgattcctctgatcggcacattttttcccgagatggatctcccccaaaacgcgacatggcccgactcagccgtaccggtgatttcgacgagaagttttttccaagcgcctgctgagaagatgcttccctcgcccgcctctgctgcattttcatgaaaaatcacgtctgtatatgaaaacgccatatcaccgcccgtaccgacagattggtataaaacaaattcggactgcttttgatttccattttcaaaacggaaccggtaatatctttttgtcaggctgacccaccccgaagcggtcagcactccgccttttactgcgacaaaatgtgaagctgtccacgaattgttatcctcgctctcttcgataaaaagagttccgctgcggtccgaataagcccacccctgtgctctgtctattaagacggctcctaaacggtcttgtccgaattggctgtagacttcaatcgcttctagcggcgtattggtaagaagctctgccattccggacaaatcagcaaccggtgtgacataatcgtttttgttaccgcgataagcttttacggcgccgggcctgccaagttgatcggcgggaaattcaaatgaatgctttttcatcggccgtcctcctgttctcatttattaaaaatgacaaataaaaaaagccgtttggcttatgacacagcatttttatagttttcgtatgtttcacccgttatttcttgaaattcctcaggcgtgatatacttcgcggccaccccttcagccagatcttcggcagagcagtcatcatagcccatagcctgttttaccatttctgttgaggcccactcataaaacaaggcgtaaacccaaaagttaagttttttcatttttttcattctccttttacgtttaagagttccagttttaaagacgctaattgcctgccgagtgactgctgcgcttgttcggctgcttttctggccaatttctcattcgccagctgtccgccgaggcctgcaagctggtttgaatcgggagccgtatctttttttaagctctctttatatgcttcgtcagcggtttccacccattcttgtttctcttcatcaaaaaatgggcgccacatgccttcgccgtttatttccggcggaaagcccgcagcgttaggcggcatcacataatctcctgtctcagaatccggataaagctcaaccggagtgcctgtataaatgttgtcattgtcatacggaaatattaatttcatattctcgctcctttacgtgagtgccaaaacaaggtcaatataatagccgttcacgttattttctatattggccataattcccgtcagcttcatatctccattagaatagataataaatttgctgtaaccggtggtgccgctggctgcaaccatcgttacaacgcctttggccggcgcacaagaggatggcacactcccgaataccacttctctgtccgtaagaacgtgtccgttcaggtgaagggtgtttcccactttacggtattgaagcggcctgtctcctgatttagcgccatttttataaggaacatttatccaaggtacattctcagtatcaagttcagtaacgaggcgacgccagccctgccagcccaagttcaaatccaaatagttcgtgaacatattatttttataatcgacggcaatgacatacccaaacgttcctttcccctcactgtcaagagaggtaaaatgaaacatgccgcgggttgaagcgttgctcggactgtttgccgctttgccggttgaataaaaggtgccgaacgccctgccgtttttaacgattttttcaagaaagttatcatcatcaccaattgtcagaagatagccgccgttatcgtttgttattttcgaaagctgtgcgccgttccacatatctttatccgcctgtgtgacatgaatgtcttttttattggcgtgagcctctacttttgcttgagagcctgaatctgtttcttgttggctccattccgaccatacgcctttagtgctgaaacttcggacgtatatgggatttccggcggtcactgtgtctataaacatttggacaaaagtcggtgatgctccgcgggttctttgcatgacaattaattgtccgtattccgcaggcttattttctgtatgctgaactgatatatagtagatgccggacgtttttatattgtctaagtttgtttctgttaccgttttagcattcccgtcattgtcagtcagattgaataactgccctgcattccatttgtctttgtcagacttggttacatgaagatctgttttgtcggcatgctcatttacttttgcttgtgctccggcagctgtttcaaatggcatccattccgtccagatgccgtttttcagcgtttttctccaaaatcccccgtcatctgagaaagcggccgcctctccgttattctttgaagaataaaggtatataccctctgacggtttaggcggggtatttattccggttgcagctgctgagaaagtaaaggtcttattctggctggcagcggtctgatgaaaatcctgtccgtcagagatattaataaaagcggagccatcatcttttgtgattttagacaattgcccgttattccacttctggcgctcttctttcgtcacatgccggtccagatcttgattgtgccggtcaaaatctttctttgctgcctgctggacattgtccacgtttccgaggccgatttgcgcctttgtcgttttgtgcgggttgttcatgtcgtttttatgggccgccagatccgtgtgggcgttttttatgcctttttcccagcggttgacgtcatcttcattaatcggatcgtccggaagccagtctgttttttcttcgtaagccatcgttacaccacctcaaaggtaaatcttaaatcaagcgttctgttattgctgagatctaaatttgtttttcgttctgtaatgacgcttcctgtttcgtcaagcatctgcacggtttcaatgtgtttgacgtcttcttccctgcgtgtgagaacggtgactgcggcatcttttacggaaatgtccgcaatcggagtttctttgccgtttaacagcacttttgtgatcctgtttttcagatcggctgcggcacgctgtctgtaagcggctgatatcatggtaagaccacctcgttattgttgagtgtgacggaataaccgaccttcagttcactgacttttcggtatctccgattgttgagaatgacccggtctttgatttccagtgtttcgtttaatgcggctctcagtgtatacgccaaatgagcgggtttgattttttcaagcgtttcaatcagctcgttcatgtgctgcaggtcatcaagcccgatatcggcataaaaacgatactgccccggaaacatccgaacataagctgacggatgttttaaaaaacggtttagcgcctgctcgatcgcttgatgtgtgatgggcggaatattcgacatcttcgagatcagcctgagccgtctcatatcctccgtgtcacctgattcccgcggtatttttaatattttttcccagcggtcaagcccccatgtcgccgtcgtgataaagagctgatccgtcaaatcgaaaatatcgttattctgccgctcaaactcaggagcttccgccataagcagttgtgccatctcttttaatcgggttaaaaacggcgggaggtacgccgtcatctcatcgagtctgctcaaggattttcacctctttgagtttaggaatttccacgtcactgagcacgaggttttctgccgcaccgttcattttaatatcggcgtagtcactgacggatgccgagttataaacgatgttgttaatttgtgataaacggacggtgttttcttcaaaggccattttcttgaataaattcagtacgcctttttcaatctccgcttttacgtcatcgatcgagctgttcagctcaggcagcacggaagcggagatttcgatttccttccatactgcgctttccaccgttactgccgctccgatcggcgcctgtccttctccctgcccttcgtccggatcaatataatcctttacttttttgatcagaatatctgatgccggttccaaattcgcatttgtgatgacaactttcaccgttccgtctccgttccaaagcgggaagatttttgccctgccgacgccgtcaatctcttcggcccattgtttataatgctgtttatttgcgctgactgcctcccggcggacacgggtaaaatagcgcgcccttaagctgttgtcatcttcttcctcacggccgggaattaatatatcgcgcatgactgctttctcaagcccgggtatcgtatcaagcggcagcaggttctgccccgaaatgccggcattgcccgcttcaccggctgtttcacattcaagcgttccatccccgtatattgaaaatacaggttatcaacgaagaaacgggagcctggcggaatggtgatgcccgctgtgaattctccggctctgaccgctttagtggcaggtgttcgttcaattcccgcctcagcagcacgcctgtccagaaattcaccctgagccgtatcggaaaacacgagctccagcacggtatccagccaaatataagactttgcgagctcagcggccgcaggcgcgagcgcattgtaaatgacgctgccttctctcgtatcaatatccgccgtaacgcgcgccagcattctgtccataatgtcgtcaaacgtctgagcttcaaacatcctcacccagcacctcctctatctcaagcatgccctcatcagtttcaacggtaaaagagacgatgaaggcatcatcttttttctcaatctcaaaattggtaacggccaaaatacggtcatcatacagcaaggcttcttctatcagtcttggaatctccatttttttataagcatccgtcgtgttctgatctgaaagcacttcctgaagttcgtttccgatatcatggctgaaaaccgaatatgaataccgttctgtgtgaagagcgatatagacgaattgtctgattgcgtccagtccgtttatcagttcattggtaatccggttgttttcaaagtcaattcggtaggtttgtgaagtctcaacagcctcactcgcatcctccaaatcttcaaattcgatttccggtgtcagggccattgcacccgctccttttagatttgttcatgtaaaaaagccctcttcggcagatgaagcggctttaataggctgatattcccgtatatctccgtccggatgccggttaaattttgtccagtacaaagaaagactgtcctcctgttaaagcggcggtcatcacccgatctcccgcctggagctgatcatcttctccggatctcagccgcttcggcacaatgagtgcatcagacggaatcaaaagtttgtcgtgatctttcagtttcagctcgagcggcgaaacggaggtcacttcggccggcatcagctccaccggcgcttcagcgtcaaccgctccgacggctaaatgtttaatggcatcacttaatctcatcaggctgtcccctccggaagtgaatttttctccgtgacgtcaatcgtcatggtatgttttgttccttggaattcatggcggtccgtatctacataataggttttcttcagcccgatttccggaattgaaatatagacgggcaatccgctttccaacccaggaataccgatcgcctgtatatttttcagctctttcttaatgccttttttctcagcctgcttcacttttgcgcgctgtttcagctgggcttcgttaatgtcgtcagaaaccgtttcggtatactgcaaaacgccgaatgttttcatgccggcgctgtctgaggcggaagcctttatcgttttattgtctttttgcagccgcatgacgacacgggttgcggtgtcatcaattgaggtgctgtattgataccctgtaatattaactcctgtttccagcacccatatgtcagacggctccggccattcacgcaagccgagcctgcctttttctgaatagagctgataattgcgccccgtctggctttttgtctgctttaacgcttttagcatcatatcgtaaaggcttgtatcatttttaaaaacgagtgatttaatagtatggcctgtgttggcaatggatgtgacgggaatttgaaaatcgctggcgatcctttttaatatttgatcagcgcgcttgttggaaaacacgtaaacgtcctggtttttcacaaggtattggagcatatcgtatgcggtgaaggcgacggtatgctcatcgggcgttcttgcaaaaacaatgccgcggaacagctcttttccgttccatttgaacaaaaccgtatccccttctgatacgccgtaatacgtctggctgccctgctttacgacaatcgtcgcttcgatggagcggggcgcctgatatctgtgtccttccagcgttacgctttctgtgacaagctcgagccactccgtttcttttatgacaaatagttcaatcatcttttcacccgtttcattgcggtatcttcagcttctgccccgggaagatccaatgccccggctgccggatattccgtttgctgcgcttaatcatggcggttttattcgcgttccagattttccgccactccgtgtgttttccgtaaaacttgccggcgatgtcccaaagcgtatccccttttttgacggtatatgttttgggtgaagctttggacgggcgcttcgctttcgtttttttcttttgtttgatttttcttggcgaagcggttttatattctttcagtacgatatcaaaattccggtcgccgatttcattgtcaccttcgctgtaattaaagctttcaatgctgcatgtgacattgatttttgtccctgtaatcaaaaactgaacgggttttttcgctttcatccatgcttcaatggctgaaatggctttttccggtgaaggaatgctttgatattcggcaatcgggctgtaccgtttcggaaaaaaagaagagaacgaaatttctttcgctcccggttcttcgataaacgtcacctctccaagtccggtgactttcacggaatcattctgcacgctgtttgcgatatcaatcgcttcagggagaacgggaagccggagcttgtccttcccttgagacagccaaaattcgtaaacagatttagtcaaaagcaacggccccctttgctccggtataaatgtctttttgcagttcatcaatcagcgcctgtttgattttggcggctaggctctcggcgtcctgcccgttatggaaatgctgatcgccgctgaattcgattttaatttcttttgttcccgttttttgaacggtttggccgccgcctttaacggctgcggaaaccgtgccggctgaaagcgccgccggttccgtccgggacggatcggacacttccatgccgagcgcctgagccgctttttgcagcagataacggccgcggatgccccgctcttcagggatgatccactcccgtttgttcccttcgccgacacgggcgatctgctccttggtaatcagacccccattggcataaccgacgtaagggccgccatgagccatacttttaatcccggggacattgctgatcgagccgtatcggcttttaatatagccgatagcggcagcggcgttgtggattggatttctgatatcattcatgcccggcgctttgtgatcttcaaaggtgctcggaatcgtctgcataagcccctgtgacgggtgtccggctttggcgttgctgtcccatagattaatggaattagggttgccgcctgactcatgctgtgcgatcgtcattaatcccggaagccagctgatcggcgtattggttgctttcattgcggccaaaagccattctttgacgcttcctcccgctgcacccatgccggaaaaggctgctgcaagcgagcctgcctgtttttccgcatattttttcacgtcaactgagctgagacctttgacgacgccgactgaagcaaagcgtccgagactcatcatgacacgggaaggagagtgaatatcaagctcttccctgaatgcgtcctcgacttttttggccatatctttggccgcctgtttgacttcgcttccttttgcagtcatccctgatacgaagtgtccgatcaggcctgaccccagccgttcgcggaatctcttgattgaacaaacggtttattgatatgtgtgcttacgtattgcgacgttcccgtatcttttgcattctgtccggccgaataacctttcactgtggcggcgccccatgatgacgattgattaacctccgattgataaggtgttttcacctttgtttttaaaaacgaatcggtgcccgtcggcgatgtattctgacctttggcatagcccgcagcgacttgctttccgtaatcgggcgaagacgaaataagggcgttaaacggcgttccgatgtttttctctttccagccgtccatatccaccgctttattgctgattccgctgtcaaagccttcagtaaactgtttgccgagtgatgaagccgtccccgcaaatccggaagcatccacagacgcagcggccgatacagacgccgaagaagaaacaccgcccgctcccgccggcacagcggaagactgagccgaagccgcgcccatatcatcgacaacacgcatgccgagcttagacgcagcttgtgaaagcagcatcttcccgcggccgcgattgttgtcgacggggatgacaaattctttaccggcttcaccgatccaggaaatggtcggctttgtaatgtagccgcccgtggcgtttttgtccgtttttttctttttatctccgccgcctcctgtgacaaagtccattacgcctgaaatcaatttgccgccggttttatcccaaatctttttcacccagtcgaatgctgcagaaaaagcatctgatatggctgttcccacttttacaagaggttcttttatatgtttctcaaaccagccgcttaaccctttccatatatcctttaccgtatctaaagcagtcgtgaaagcgtctgatattccttttccgactttttccaccatgtttttcaccgggttccagacaatatccatgaaccagccggataccgtactgaaaacagatttaattttatcccaagctcctgtgattttactccaaatggacgtcgctactccgacgacagccgattttacgggctcccagacagtgctcataaaccagccggatactgtgctgaagacaccttgaatcgtcgtccacgcattcacgatatttgaccatatgcttgtcgccactccggcgacagctgatgaaaccggcgtccatacattctccatgaaccaggatgacaccgtgctgaaaatcccttgaatcgtcgtccatgcattcacgatatttgaccagatgcttgtcgccactccggcgacagctgatgaaaccggcgtccatacattttccatgaaccaggatgaaacgcttccccaagtatcttgtactgttgtccaagcactttgcgccgcttcggaaatatcattccatgtgtctttcaaagcccctgaatcaaaggcctctcccaagctggaaccgcctaaactgccggcgatgccgcctaccgcgccgccgattaatgtgcccactccgggaacaacgctgccgattgccgctccggccgcggctcctgcaagaccgccgcctgctgagccgaccttctctcctgcattatctttattgatgccggctaaatcagtaagtgataacaattcacctatgccgggaattcctttagcggcaccttttaaccctttcataccgcctttcagcgcctttgaatctcctaagcctttcaaaagcccgccgatgcctttacctgccccttttgttttcggcgtgtttacggatgcctgtttgctttcctttacggaggaacctcttttcgaagatttattccgcccttcgactttactgcttttgcccctcgtcactccggtacagcagcagccgccccccaaagccccgccggtttttttggctgaccttcctgaagatttcggtgatggtcccgtgcgctgcggaccctttgtcagctcaggacgcttcgggctgttggtgccgccggcagaaaggctccccttactcttttcttttttcgtgccgcctcctaataatccgccgatattgagtttgcctaatttttcagcgattcctgaaaatattttttctattaattccccggctttttcgatgattttgtccgggctgaatttctcaaatttcttggcaatcttgctgacaattttatcaacaaatgcctcggctttttcgatgatcgcatcagggctgaacttgccgaactttttatcaatgcctccgaacagtgaggaagtaaactgctccactttttccagaatcttatccggattgagaaaatcgaatttctcagaaattcggtcaatcgtgtcatttacaaattgttcggcgcggtcgattagcttatcaggactgaatttaccgacaacgtcgtcgactttcttcataaacgaatcagtaaaatgatccagctctttcaatatggtctccggactgaatttgctgacaacgtcatcaacctttttcataaatgaatcagtgaatttatccagttctttcaatatggcttccggactgaatttactcacgaccccgtctacctttttcataaacgaatcagcgaatttgtccagctcggctaatatcgttgccgggctgaatttgctcgcgatttcgtccgcttttcccatgaataaggtcgtgaacttatccagctctgctaatatcgtctccgggctgaatttgcttgcaatctcgtccgctttccccatgaatgaggtcgtgaacttatccagctctgctaatatcgtctccgggctgaatttgcttgcaatctcgtccgcttttcccatgaatgacgtcgtgaacttgtccagttcggctaatatcgttgccgggctgaatttgctcgcaatctcgtccgctttccccatgaatgacgtcgtgaacttgtccagttcggctaatatcgttgccgggctgaatttgctcgcaatctcgtccgcttttcccatgaatgaggtcgtgaacttatccagctctgctaatatcgtctccgggctgaatttgcttgcaatctcgtccacttttcccatgaatgacgtcgtgaacttgtccagttcggctaatatcgttgccgggctgaatttgcttgcgatttcatccgctttccccatgaatgaggttgtgaacttgtccagctcggctaatatcgttgccgggctgaatttgcttgcgatttcatccgctttccccatgaatgaggtcgtgaacttgtccagctcggctaatatcgttgccgggctgaatttgcttgcgatttcatccactttccccatgaatgaggtcgtgaacttatccagctctgctaatattgtctccgggctgaatttgctcgcgatttcgtccgctttcttcataaagcttgcagcgaatttatccagttccgctatgattgtttccggataaaatttggatgcgatatcattgacttttttcatgaaggtgtctgcaatggagtcaagcattgaaaaatcatttttcggcgaagcaggagcagcagatgcagaagcttttccgacgtccggcatattcttttgcattgcagccagctgtgctgtcaccttttcgtttaacgataattgaatgacattgtttttccccgtcagcgaatcaatccccgctgaaattcggccgactgttttcatgacgtgatctatgacgcgtatagtgacagagtacccgttctttaacgcagattgcatgtagcgtttgatacgttccatggcaggagtcacttcgtctgacgcatacagtgaaacggtaaatcctttaaaaccggcagccagatcccgcaatctctcaaatgccgctgtcgcgctgtcttttgctcctattttaacggttaaagacgcaggcagacccgctaattgggcttgcaccttttgaatgacggcactggctccgtcttcagctgaaatagagatcatttgtgcgcccagctttcttttcatagagcgctggatgcggtcaattgttcttaaaacagatttactctctttgcgtatatcaatttcactttggcgttttgtcattttcctgtatttctcaagcgctctgaagccattttggattttccttattttctttgaaacccgatcttccaattcaaaacgggcggtcagctttgccatgatgtcgctccccctttcttcgcttgtttttcaagaatgtccagcttgtaaccgattaaaccgtacaacagcgccttaaaatgtctcggtgcttcatataactctttcagttctgatggagaataatgaagctcatgcatcgcgtaatagagatacacggcttccttattcccatcttttatcagttttttgcttcttgctccagatcttctaattcatcttcaaaaccattgatctcaatcgctttattcagccaatttgcatactcaccgccgactgaaagaacgcgttttgccacctcgaccggatctgccgttttgtaagcgtcgcggagctccttagaccggaaatcagggtaaatcgtagattcaaccgcgatccgcgcatagaagcgctggctgtctaagtcttttacgcggcctctgcccttcacatttttatatgtcgtgctttccttctccagttcgtcaatgcgctcagtcgtaatggctttaaaaataaaaggcacgatgtttccttttttatcgacaaaacgctttgaaagcggaacccggatctcctcagcctcgactgttttacccggcataaagaatgacagatcatatacttgttcgtttttttcgctcatgatgaaaactcccttactctttttttataaaaaaacaggcctataaaaggcctgtttcactcacaatgattctggttaaaacgtttcagaaagcttttccggcacatcgaaatcttcaaaggtaaacggcacttcttcttcgagggcttctgagtctacgtccagtccggcgatttttgcagaatcaaagttgacgtcatacagggtgacgcgttctgttccgcggcctgatgatttgtcgtcaagaacggcttgcagcgtaaaatacgggtcgctgccttttttgacgtaatccatcataaggacggcgaatttggatgtgaccttatagaatgttgccgtgcccgttccgttggcgcctgttgttttatgtcccgtcatgcggcggcccatgatgtttacttctgatttgtttttttccacgtttgcttcaaaggttttaatatgcgccatctcttctccgtcgagaaataaacggccttcttttcctgaaatcgtgttttgcgcttttaatgccatcttagtttacctccacattaaagtagaatttttctgccgcatccacaggctgtacggcgagatcgattaaaaagccgtcgcggtcttcattcagcccgattgtaatgtctttgtctgaatcaaagttagcgatgccgcccgcatcctggagcgttgtcaaatattgaataatcatcgttttgacgaattgaaggccgtcatttgtcgcaggaagatcgcttccggtgccttttttcgatttaattaaggctttcagttcacgtgtcaaatcgttattcaccgcatcaagcacacggacgattttgtttttcgcgaactttttgtttttctctgccgtaaatgtcaccaatgagttgatatctttttcaacgctgactgacttatcacgggcatcataagagaaaaggaattcacctttggaaagacgttcgatcacttcatcatgagtcaagcggtgcagcacatcgacggcgccttcgtattcaacgaatgttaaggattgattaaatgcggcgctggcacttgcgcctgccacccaggcggtcgcatcttcagctttaatctcagttccgtcttccagcagcacaccttcagtcacattgataatgccttcataatccccgctgtaatgggcggtcaccccttgcactttctgtccctgcgcatcgcgaaggcgtttaatgaatgcggcaaatgtcgctttcagctgatcgttttccgcgacaggaagagcgatgacatcgaaattctccgtttcagccgcagctaaaaaatccgtatagtctgagttgaccggtgctttatcagttcctcccgcgagacggatgcctgcctgcgggtttaacgtttccccggattcttcctcagtgcctgtcagcgggatggaagccgacagttcgcccgttcccgtaaatgtgacatagccgtttgcttttaattcttcggcttttttcaccgtttgtttgtcaacttccgcttcatccatgtaagtggtcacatcgaaagcggtctgatcaaggacgttttcactgatgcggatgatgatgtcatttccttttgaacccccgtacaaagcggttgctttaacaccttgcgaaagatctgcgctcgctctgattccctctgtcagacggtacatcaaaacggtttttgctttctttttcgcctcacgaagcagaatcagtgacggatcttcaatactgagccccacttttttattcaaatcctcaacgcttgaaatggaaacgaatgttttcgcttccccccagccggatgcgacgggaagggcgacaatcccgcgttcaccgatcgatacccgctcctgggcggttgttttaaagttaaaatagattccggcacgttctttttcttttccttgcgtaaatgttccgccgttcattattgcatgacctccttggttaaaaatgcttcaatgtaagacttggcttgcgcttttgtcatttgtttttgcttcacgccgaataaagcaccctggagaatctcgggttttacgccgaaaagctccttcgcgtgctttgttaaatccgccgtgtcataaagaaccgctcgttccgccgttgcggcgtttttctttttatattgtttcacttttgtttcaccccgctgttaatgtccacatcccgcagtgcgggagatgtttgtttttgatagtagtagcggctcgtccagcggatggtgatcactgcctcgcctttgtctccgactcttgtttcgatacggctgatgcggacgaaatcaccggtatcctcccctgattccgtaagcagcggaatcagctgtcttgattctctcaccgcatcggcgatcccgtcggctgcatagagggcctgcaccgagtcggcatggaacagcttcacattcagactgtatgtcttcttaaaggtggagactgtgtcattctcgtcaaaagcatacgggggcgggatgtaaagtgacggcacctgaaattgttcaggcagttcattttcatatacgggcacgccgcactgctgatacaaaaaagcggcgattgaaccggtctcgcgattcatccgatatctccccccaacgtgttaagccactgattgaaacgcttgtccagcgattcggcgaagagtgtttcatacaaaagaagggctttgtcccaaaacccatttccgctgatccactgttttttgagcgccattcccgttgaagctgacggatcatagatgaaccgggagccttgaaaatacccgggcacccatctgacattttcatctgagacggtccaatgtccgtcatttatgaatgaggcatactctacattggtgccgatttcaagggtcagtcccccgttttcaatgatccatacgtgatcctgcgctcctttccggaaagaagacagcaggctttctgtatcaatcccgcccgaatgaataagctcctcccgtaccaagtcgagaaaatcctctcctgactgttccagccattcgcctgcctgacgggcaaattctccggatgatgccttttgcagcgaccgattccattgttcaaggttttttatgctcatagtctgtcatctctcacagcgataacctcccaatggtgctgtcttgttttcttcggcatttccagaatatacgcctgtccttcccaaatgattttgtcattgacacgcacaacggcctctttcggaaaatgaacgagaaaccgctgatataccttatgatcaggctcaagctgaataagctgctgctgtttttcaacaaacagacacggcacgtcttcataatcgggcacttccggataagaaaagacaggctggagcttttcggcgggaatcccgaagcgtccggccttcggaactgacaccgtctcatgataaatatcgcatctgtcagtgagcagccgttcgtagctcataaaggtctcacctttgcgtgtgcagaaaccggagaataacccggcgcgatatattcacagagcagatggtgcaccgccggttttctgattccgccttcacctgccaccgtatacgagtagtcgcctatcttttcagattgataggcggaagcggctgcttcattctggttgatcagcgcaaaatattgagaaagctttaataacgcaagcttaatcttttcgggaagcggtgagtaaacagggtcagtgaacgaatgccccgccattctggccgcctccgcctccgcctccagaatgtcctgtataagaagcggctccggcctgtttttgacttgatcataaactgaatatgaaacaacgtcagacggctgaattaacataactgccacccccgtcttattctttaacgtttacgattttggcgcttgcatcttcttcttcaaatttgctgtcaagtttagccgtcagtacgataataaatttgcggctgcgaatatctttatctacttcgattcggatatttcttgaaaaaccgagaatgatatttttcgggtgagtcaaaatgatgtcagacgcatcgtactgggaatcaccttctccgactgagtacggctgcagattggacactcctttgaccggaacgccgaatgctgaagacaaaccgccctgcaccgcaagatctcccagattggtctgacggtcagccacacggtctttccattcaatctccatgccttgagatgtgtaaaatctgaattcctgaggcagtcgcaaatattttgccggaatggcttttaagccttttttaaatgtggctctggacagctcttccccgtttccgtcaatgacgtgagatacagtctgcttacggattccgtcaagctgtgccaagtacggatcagaagaagatgtatcgccgtttacgactagctcctcaatatcgactgccgcccgctccgccaaaatctgcatgatcgtctgctgcaggccgtctttttcaatattgttttcaagcgtgtcataggtgatattaatttccgcaatgacttctttcgtattcagctgcaccgtacttgttgacgggacggtcagctgatcgtcagttaaggcttttccttcctcagcggcacgcagaatacgctggccgaaaccgattttttcaaatttctgcgagtcattttccatttgaatcacacgcgattcgctgaaaatggtcggcgtgttctgcaccatgcggataaatgctgaagcttgtgcggggttcattaaaccgccgctttttaaagcggaaagtgacatttccgcctttctgatgatatcttgatttctcactctacagttcctccttctgactgggcttaaagcagtccgctccaaatggattttttaacaggctcttgaccgcccgtctcttcttccggctgctttgatgcgcctcttactttttcaagcgcttcaatgcgtttaataatcggcgccagcatgtcctcaacaagtgttttcagcttttcttcatcagacggcgcagccgccccgtctttgtcttccgtgttctggtccaaactgtcaagccgctttaaaagcgggtgcagcgcgtgttcaatcgattctcttacgtcttcttttctcatcttgttcaagtcctctcccttgcggtttcttgatttgcggtcacggtcgagaaattgcttgactgcgccgaataagccggcttgcttttctgccggctcttcgtaaacgtcagcggttcccgccatgctgtagcccgtaatgataccggctttaatctgatcccatacttcatcggaagctttggtgacaagcacccaagatcctttccggatcacagcattcccgatttcaaagtcatccggggcgacgtacgactccaccacctcgccggtcccgccttcaaaattatgatttgtatcgatgttgcgggcgtccgccaaaaaaccgtgagcggccttttcaatctcttcagccgtcatataatcgccatgtgcatcggggacatccggctcgtaaacgatgccgtaaacaagcttctgctcatccgattcgttttttgtaaacacctgcacctttttttcaaatgacggaaggcctccggctgattttgtaaaaaagaattccgtttggttcgccgccttatcgacatagctcacaaaactgatgacggcatttctcaattctctcggcacgagatgttttcaccccctttcaggattgctcctatttccctttcagcaccggccggctgtagtactcttcaggccattcctcaagcgtcttgccgagcactcttcccgccagatcacggaggtcattaggagagaccgcgccggcggaaataaatggcgtaagcaccttcgcaatttcaagcggatcgcgaaaatcaggcccttttaatgtgagctgtacatcgtggagacccagttcaggcaaaaataacgtgttgagcttattaatcagcgttttccgctccggctgaaacacctgctcctccgttattttccgtgccgtatcggctgtggctttgttgtattcctgcgcctctcccgtataaagcggcgggagacggaaagcggaacggagtttatttctgcttctgtcgtcatattcaagaaacagcgcatcatcctgcagaatttccgcaagtgatttaatttccacagacacgggcgtaatgtcttcgcctccgtgaaggtctttttccttcgcaatgccttccgcctcaatcagcagaaatttgtgggcgttttccaccccttccaggtcattcatataatcctgaagctctttgtacgaggtttctgacagcatgccgttttcaaccgtaatggcggccggcacgtgacggccctgcttgaaatacataaaattcagttcttccgctttccgggcgccgtacagattgacgatattgccgacccagcgcggaatgccgtaagtgccgctgccgatttttaagtgaatggcttcatttgcccggtattcttcagacagggtctttacgtattcaccggttctcatgtccatcatgcggggatcgccgtattccttaaaaaacactttccgtccgttcagcatctgaacatatttacggaaccgtttttgccttttaatcgttttggatgcgccgttttcttcatatgaaaatgtaacttcaacgggatcagtcacaccgcagacgcgcatatgtttcacatccagatattcaatccccgccggttttcccgcgccgtcccgaagcacttcgagaaaaccgttgcccgttttttcgcggtcttctatcgcatatccgaggaccgtctcggccgattcatcaaaatgaagacatttgtaaaagctctccagcttcatccagtttttttcggcccgggcctttttagacggtgagcaatctgggctatttacatcaaaggtatattccacatcgaacccaaaacccgtaatattgacccgatacgcgtcaatgcactgctgaagaatcgtcgagtattcggcgattgttttcagttcaatgagattatagggcggtgaaatgatgtcttcgccgtacagatcggcaaattgatcttcgttcatctgccttgcctgcggcgcggccatttttgatttaaagacggtggctctaacgttttgatagttaggcaacgcctatctcctcctttcccgattcggacgtctccgtttttgtgatgcatctttcagatccgccgcgtcatagtcatccagcgcataccaaatggctgaaagtgtgtggggatcaattgaaaactcatcttccgacagaacgccgtttttgttttttgcgtacgttaagttctgcaattcgcggatcgtattttcacagctgtctgagcaatagatatgtttgaaccgtttcagcttttttgtatactgaagtcttgagcccggaaactttttggccgcaaccatgcaaaatccctgcctgcggaaatattggatgcttttcggctcagccgaatccgctttgatcagctctttttgatccgccaattcttgaagctcctcagctgtctgatcatcggtcattttgtttttgtaatactcccagaaaatataaagctctttttgatccggatcgacggctagccggatgaccgcattgtatgactcttcaaaaccgaaatccatgccggtccgaaacagggggcgcctgatggacgcaatccgctccgttacttcgttgtgctccatgacctgaaactgcggaaacacgcggatgccgttgacgccgaaccgtcctttgcgggcgatccggtacaaatcaggatcgtaatgccgtaagctgtccagctgcttaatatagcttttcggcaaaaacagattatcgcacgctgtggaatggtggtaatacgtatctcccttaacgacggtgcctttttcatacagcgtctgatcatccaatacgaaccgttttttttggtcatcacgaaaaaaatgccggtacgtccaattggaggtgccgacgggatttgtggtgcatatcatatgcagcgaaagctcgggatgacgcagacggccgatcagctccttaaagccttcatacttcacttcagagcattcttcaatccaaatcagtgaaatatgatgaatggatttcaatttggccgggttgtccatccctttaaacataatccggcttccgtttgaaaatctgagctgcatcggtgaagaaacggcctttacggcatgtcccagttcaagctccgtgataatgtcttcaaataaggcaaacgtagaatccctgtgcgtatcgaaaacttcccgcacgacaagggccgtccgcttttcacgaagcagcttcaggatgattttcagcgcggtatgatagctttttgacgagccgtagcctccgacgagaaattggtacgtttcattccaattgaacaaataatcttcaaagcgcgggttgaccgctttttcaatcatggccgttcctctttccgcgtaatgacaatgtcaatcggcttttggctgtcttctgttttttccatcttctgctgtgccagctttaatttttcattttcgattttttgtttaaattggtcagggaaaaggtcaaagtacaaggacagcttttcaagagccttcatcttgtccgcaagctttattgcaatgccttctttcccgagttttgcttccgtgacgatggttccgtccagaaggtgcgaatctttaacgtcaacgtagctgatctcctgcataatcggattatcattctcgtcaaagagcggccctgattttccgaaggcctgaacctctttttttccgaaggttacataatcggtaatgtcagcgaaagcgattttcacatagacttgaagaacgtccatcgcttcgacaaacactttattgaccatttcctttttcatgcggctgatttctttagcgactttttcgttttttaacagcctgcttcccgtcacatgcgcgctttccggtgaatacccggcttttatcgcagattgggtggcgttaaagcatttcacataataaagacaaaacagccgctggcgttcgtttaactcatcaccttcgcccgggttgttttttccgccgctttccgcgttctttttaagcgcctcgtcccagcgcccttcttttttccatctgccgattgttcttgcggatacgcctgatttgccggcaagggcgcgatttgtgatgcggcctttatgagactgatagattgtaaatgcctgttctctttttgcgtttttcatgctacggcatcaccgccacctccgacatgattgtctataataaaaagcggcttctaatcgggccgctttttgtgatcgtctgttcacttctaggtggcaaacgtatgacaacttatgaagcaggcgattgatttctttgttcctgctgtttttgaattttcagaagcgcccgtttgaccgtcgtttgtacggttgatttctttacattcagcaaggcggcgatccgttcatacgaaaagcattccgctttgtggagcagcagcatttctttttctctatccgttaaaacggctaatgcgtcccgcagtctgattctgtcttcttcagtcacatttgcggacggttcaaacatcagcgcctgcgaataggtttctatgattctcggatctttaatgagcattctctgataagcgtctctgcggtctatcgctcttcttatgccgggctgccggcctttttcaagccattcgatgacatattccaaatctgtaataatcgttctgatgatttttttatctttcagttcttctgaagtaaacaccgtttcatccgctgcctccagctgcttgtaccactttttcgtctctttcagcgtgcgtttatattcaaatagtaagtcttccatgtagatcctcctctttttcggaacaaaaaaggacaccaatcaatgcgcagcatgtgcgcgattgatcagtgtccgcaggctttccgtcttggacgtattctgtttttttcgattaattcaatttaaagccgatttcatattcgacccgggccagatccccttttcgcgtttcgacaagcgttttgccgtgctccggcgcttcggcgagccatgcttccttcttcagtccgtctactataatcacccgaaccttgccttcttccagctggctttttaatgttgtatgttcaatgtcagtcagttttttaggattcatgttttacttcctccatctttttcaaaatgttcacttcatgtatgaggcttccgagctcatttatgaacgcttctttttcttcagaactttctccccggagcaggcggagagccgtttcggccgcctcaaagagttccggggctttcgccatcaatgccgcgttgatctgctgtgagtatgaacttaagttgaaaacggccgcgatgagccttccgtttgaataagggaacttctctttatccgcttcgctgtaagcggaataaatgtaaatgggtttttcttctccgctgtgtacggcccgccatggagcggggctgtttttttcttgcaatggtgatcctcactttccatcagcctcatgccatgcttcaatttgcttttctatccgttttgccctgaacagcaggcaaaaaagccatttgatatatttacacacgtgcatcaagcctcgcttttgcgtcttgaaccattcgttcaagccgtttaatgaccggcgttaaatcagtgcctgttttgcagttcgggcaagggtgaaagacagcgccgaaacccgtttccatcacaatgaccttcttcggcccgcacagcttacacattatctcgccccctctaatctgtggtttacgtcaaatgaattgccattaatgatgactaaataatcgctgcacatctcataaattcttgtgcccaaggcttcatcaacctgcaccaatccgtcacaggccagctcgctcgagataagaaccggcttatgatttaaatagcggtaattcacgacggcgtacatttgttcaatctgccaatcggtcgcccggggttttccgttcagcggtttgaacagatcgtcaataaaaagcacatccgcctgtttcatacggccaagctttgcatcgagcagatcaaaatcattttttaaatccgtaaagccctccacaaaaggaaaatacagcaccggtgtctgcttctgtctcatgacataattgctgagagcggtcaaaagatgggtttttcccgatcccggacgccctaaaagggcaatgctgtttttccggcagtttttcatcttgtcgaagttctcaacatattcaagggcgcactcatatgcgtcgacgactgcctgaggcttgccccgcgtgataaatcctttgaaatccagcttccgaaaggcatctgtaatctcacttgcgccgagaatgcgttctactttccgttcggcggcgcagcggcacttaacccatacttccattcccagctggtttttgagataaccgccctgatctttacagagcgggcagtcaaagcggcttttgtctgattcttccggtctgtccgccagtaatggacgttttccgtttttcaggtcggcaagaatctgctcgatcgttcgttttgtcatgtatcgtattcctctctttttttgttgtgattgtccttcccgcaattcgtgcattcaagcggtcttccataaacttggcgcaatagctgaaagccttgatcgtttcagctgaagaggtgcgccgctgttcaaaagcggtaaagcattcgccgagccatttgattgcttcttgtgctgacgcaccgagggaaacaatacgggcgatggcctgataatcccggggcgacgggtatacgctccgcccctcctgtgcagaccttaatctgataaaatgggcagcaatgtcgttaatcgcttcttcagcagtatgattttttgttatatctatttctctccggacatttttgtcccggtgatccgccgatattgtccggtcagttgcttccgggcgggttaatgtctttttcggcgtgaatcttttcgagtgctttacggagacgatgagtccgtaaggggcgcggacggttttgatatactcatgctgttccaagctctcgagccaccgcctgacggttttttcgctgaccgcgaatacatcggccatttctcttgcttttacgggcttatgtccgaggacgatcccccactttacgccgtcttttacatgttcctttgtcgttgagctgatgaaccataaaaacagccaaatggcggaccctattttgtcataatgttctgaattcaataatccagaatagatgaaaaacgggtagcttttacgtttcataagggacatctccatttttcttcagacctatatagcgttcatactgcaatcggttatcaaatcggaataccggtagtccgcaagcggtaaaagatatcgaaccgcctgcttttcctaaacatctctggtcagccggattgctgctgaaacggatgattatcggctgcatctctcaccctcctgatcaatttcttatcgtattttgatacattttgtatccctatgatgttgattatatacgatacatttcgtatcatcaagacctttttgatactttttttatcatctctttcttttgatacattttgtatctataatcataagtaacttagggtgttgaaaaaagagaggtcatttcggatgataggcggaagattaaagagtctcagaggtaagaaaacgcaggaagaagtcgcaaatcatatcggtgtctcgcgcgccagatattctcattatgaaaacggccgatctgaacccgattacgacacgctgcaaaagcttgcggattatttcaaagtgtcgactgattatttgttaaccggaaaagaaccttcagatgaagacatgtttgccgatcccgacctgcagatcgcatatcgggacatgcaggacttttccccggaaagcaagcagcaggccattgaattcattaattatttaaaagaaaaagagaaaaaccgcaggccgaaacataaataatccgctcttttcctttaaactgcttaacgttcagccgatataaaagctgaatgtttatttttaaaagaaaagggaattgattcaaagtccgatcagggcttttctttctcgcttaaaaaagaacatatgttcgaaagggtgtattcaattgggcgattttttaacacatcttgaggaatacgtcaaaaacttatattgccgcatgggaatgaccgcccctctccatattgatatgcagatgattgccaaggagcttgacatttggattcattttgaagatacgcacagtatgatgctgaagcgggacggcatgtacagcatcgtcctgaatcaaaaaaagtcacccgaagagcaatggcaggattttgcgcacgaactgtgccatgtgctgaagcataccgggaaccattttcatatgaacaagctgttcagggaactgcaggaatttcaggccaaccattttatgtaccacttctgtgtgccgacctttatgctgttaaacatggagctgccccagcggaggagccacgccgttattttaatcgcagccgctttccgggtgacggcatcatttgcggaaaaaaggctcgagctgtttgaacggcgtaaagcaggtattcaatttcagaagcggctcgcttgtctgttatccgacaagcggccgaatgtgtattatggaagcggacagacacacttgcatgccgctgaagaaaaaacgccgtattttattgaaaattagcgattctccgccggcttagaacacagccggcagaatgtcatcattttgacatcggagaaaaggtttttgcatcatgacgctgtaatcaccgtgctgcccgccaagcacttcatgcgccgcatagctccagtgaatgtaagaacgggccccctgttcatttatcataaaaaccggccttcacggtttctacataccgaaaaaacagatcggttggcgtgtatttttctccccggcagccaaaattgctgaacagcgcgtgtctctgcgccgtgctcacttccaattgcagccccattttcctttttgtccgattgacaatgttgccgggatttaaccctgccagccgatcattcttctctgtcagctcggcatcaaatcccgcttcacgcagcagatcacaaatcagtcttgctttttccagatccgcgcccccgacgagtgtatttgcctttttcagatcatgatacccgtgaaaagccaatgcgtaatgatgggcggtcactttttctaaagccagaggctcgtcaaagcgtgtgcttgtcaagtggagagaacggttatcgcaccgcttcgtcccttcaaataaataaattgagctttggtcagaaaatgcatgcaccagctcactgacacccggctcaatcctgccgccgtggggagcgaggacgatacatttacttccctctttttcttcataaataattctgtattccgattcagcagcggaaagggctgcgaaattgtcatatctatctttcatgtgtaacatgctctccttttccagtcagcaccagtttactctactcatctgggaatggaaacctttttatagtatgatttgatagaatacgtatcagggaggagatatcatggggttcatcaacggattgctgggcaatgcgtcgacaatatcgacggctgaagcaaaatcagaactggcccgtattttgctggaaggcgagaatgtcaatgccgcatttaagcttgtccgagatatcattgtctttacggataagcgtcttattcttgttgataaacagggactcacggggaagaaaacggagattcaatccattccgtacaagagcatttccagattcagcgtagaaaccgccggccgctttgaccttgattcagagctgaaaatttggatttcaggcgcggaacttcccgctgtctcaaagcagtttaaaaaagatgaaagcatttatgatattcaaaaggcccttgccgcagtttgtatgtaagaagaaacggaagcccggggagcttccgttttcttgattacagtttttcttcaattttcgccttcgttttcgggccgtaaattccgtctgccgttaatccgctgacggattgaaaacgttttacggcatttgccgttttcgggccgtaaacgccgtccgccccatgattttttgctcctttatcgggataaaaataaagtgcggataaagcgttttgcacttgttttacgtttgtccctttcgtcagcggtttcgtcactttgatcacaccggatggaagcggatatgaagacacagcctgactttttgaagaagaacccgtctgagcgagcttgatcacttgtccgactgtaatgtgattcggatcggtgatatggttgatgctttgcagcgattttacgctgacaccgtgcgatgcggcgatttccgataaggtgtcgccttttttcacatggtattcagacgcggaagaagaaatagaggcttttttcgccggcatacttccgcttaatttcttttcaatcttcgccttcacttcatcccagcggccttcagacaaaatgcggtgcgggcagtactttccgttccagtcctgatgctttctgattctgtcaatcccccagccccgttctttcaaaagctgcgccgcaaacgcaatcgccagttcttctgcggctctgtaccgttcgccgcctgacttgctgtaacagatttctatagcaatcgacttgcggtttccggtaccgttcgtgccgtctcccgaatgccaggcattccggtccaacggaattccctggatcacttctttgtcatcaaccgcaaaatgatagctcgttgattcgctgtttcccgtcatatagctgatttcattagcggcggatgcgtcgtttgccgtgttatgaatggtaatatactccggcgtcatcggattcggacattttaacgcatatttatcagccgatacgagccgttttttcacttcaatccccactcttcatctctccttatgcctttttcatcaataggtggcattcgtaggacagataacttgagcatatcgaccctgcattcggataaaattggaatggacacgcatgcaaaaaataagacccttccaaagaagggtctttatgttatgtttggttgcgtgcggcaatatggaatgtgccgtccgcttggttttccaaatggctttcatggccgatcacctgtgtaaagctgaacccgacagcaacaagcagcaatcctgacaacagtttagatttcatatagacaatctcctctctggatttgtttttgggcgtgcaccattttttcataaaacgtgagcgctttttcaggctgtccgtgtttcatgtaaaatttggcagcgtcatgcgccaattcttccacatacggatacaacatgtgttcttccagaaaatcaaacgtgtgcctgacggatgcgttatccatttccttgccgtataacgcatgcaaaaattggaacagattgacaaacaattcatcattgtattcgcgggcgatactgagcccgaggcgatattgcttctctgcttcggctgtagtgttctgtttataaagaacctgtgttaatgagtaaatagaatgcggaagattatcgaacttttctgacctgcaaatggaaacggatgtctcaaaatattcggctgctttagagaggtctcccattttttcgtaacagtttccgagattatataaggctgaactgataagacggggattgccttcttgttttgcaagatctaaagcaagttctaagtggggcaatgctctttctggatactgcatgtcatcataattccctgcaataacgaattcacattggattctgcggacgttgtacgtctcatacgattggtacgtttcaagggcttgaacggcataactcatggagacgtaggtttgtttcaggttgtaaaaaatctcggccattttaaaagcaaactcagctttctcgatgtcatcagaaacgagtgcaaggtttttttcagcccgtttgtaatacatcatggcgtttaggaacattttctgtttaaattcgtacattcctcgaaaaaaattaaagtagtaatcaagcagtcctgtcagtttatactggttgccttcaatgtcttccaataattctgaaaactcaggctgagaagggtcctcctttaagggcttgatgtaatccagcatgacgcggtgtctgaattccattaatgaataatacagcagcagatcctgatcttcttccatatcctcaatctctctctctacttcacgtttgacgcgctccgcctcaaggacgtgaaactgccggatatgggtataccattcattaattttgagcccgacaaaagaggacggaatagtctgcttcatcctcaataaatccccccttttggaatgaccgagatatgtcatattttatcataattgctagaaaaagaagaacgcaaaaagaccgcaattgtcgaatttcggatatccgcaacgatttatctccatcacaagcttattgcttgtttcttccgtgccgttgatatagcatatccttgcagcttttattctgtattaaatgggggttttcacatgacagcacaaaatcaattggtcagccactttctgtcacatcgaaacgtgacgattgagctggcggaaaaaatcagccgcgagcattacgactacaagccggcggagacatcaatgtccgctcaggaacttgtaaaacacatcgtttattcttttcttatgtttgcaaacgtcattaacgacggaaacgggtcagctatccagaacaaaccgaaagaagaagcggaaacagacctcgtcaaactggctgaagcatgtactgaaaaaacgacagacatcctgtcacagctgactgaagagcagctgaaccgcgaaattgacctgactgcctctttcggcagaaaaataaccggcgcggctctccttcagcttgccatggagcatgaaattcatcataaaggcaatcttttcgtgtatgtcagagaaatgggccacacggaacttccgttttatcagcaaaaatcataatccggccatcatccgccgatctgcgaaataacagcaggcaggcggattttttgttctgtataaaattttccgaaaatttaattgattaccgcctcttaatcatatataatctgataaaaatagtaggattattcaggaggcacacagatgactgtaagcattgtgtttatgggtttctttgtcggaacgctggtcggattgacgggtgtggggggagcggcgcttttgactcctttactgatcgttttggggatcaacccctcaatcgccgtcggcactgaccttttatataattccatcaccaaactgttcggtgtcgtttctcattggaagcagcgcaccgttcaatttaaacttgtcggctacttggcgctcgggagcattcccagcgcaacagccgccatcggtattcttcacttgtttcccgcttttcaccagcatcaggagcagattatcaaacaggcgctcggctacgtgctgacccttgtcgccatttccattatcgcccgcctttttttcgataaaaaactgcggccgaaccgctggcagcaaaaaacacttgaagaaaagcggacactcatgatactgatcggcgtcattttcggcttcatcgtcggcctgacatctattgggtccggctcattatttgcgatcgccatgttatacctgttcagaatgaaaacagcagaagtggtgggaacggatatcgcacatgcctttttgctcgtaactgttgccggtctgttaaacgcaagcttcggaagcgtcgattacctgcttgtattgaatctgttgatcggctctgtgccgggtgtgcttctcggcagcttcttttcgccgaaattctcaccgcgcccgctgcagtttgtgatggcggcgattattttaatcagcgggataaaattaatctaaaaaaagcgtcctttacaggatcgcttttttatttgggaaatcccctcaatccaaagccaatggggtgggaatttctttattaactaaccttaaaagtgcatataattgtccggttttccctaacatcataccaagtcccgaatgatcatttcttattccattttgccagccatttttcaacagggtctctttaaaatggttaacccatatattaattgtattctcaatctcttgcttgcgatttttaaagagagataattccttaatagcgtgaagtacatctatattccccatcgttccatggcataatgagtagccctgacgatgggaatttccattcagcaatgtgtcatctaaagactcattaatatacccaacgtgaatgcgcccgtctacattctcgtatatcctgcttcttccaagaagaataccgcaagacccgtgacaccacattgcggaagaataatccgactcattttttctgttatccctccatttttttattttagtatcaaaaaatttatcttcgtatttgagagctgattcaatcagtctaagtacttctccagatgcctcaatatgcgcataatattcagatagtgcataacaaatcccagtaataccgtgagaaaaccctgctaaaacaacattctcatccgcgtcggatttccaatatgcttcatttctattttgaatcattcttttgcatatttctttacaaactgcccttgccgtatcttccattaattcagtccgataatacctgccaagctgaatcacaacctttaatatacctgcgagtccgcctataaaatcggtatgtgttatttgagcggtttcctgacgaagtttctctaagtatgctttacacatactattcacttcattttccgaataaagtccggtacctctcattttattgacaaaatagatataagaacttgacccgtaaaaagcagagaaatttgttttataaatactatgctcatatatttgattaattgaattcactattttacgaagaatcgatttgactttttcatcattataaataaaatcataagctgaaaaataaagccccactccagctaacccatcgtacagcccaaaactcaacggtcctacggataaggtgccattgggagccgagactattgatacccattgaagatatttctccgattcgattgcttgttttaatatacaatctgtttctatttgaatcagctctttgatttgtatgtcattttttaaatatccaggtacaaaatcatcaatttgatttttataaataatatccaaattagccgccgtggagcttaaggccatatttatcaagctcacttgctgatgcatgtcttcttccgacatattcgctaaacgagttaaaacttcttgtttagcgctttgtttcataatccctgtatccaccacatgtattgaatttgaataaacccttttttcactaataggagcattaaaatagggtatatcaccgatcatcatatccttgatctcaaatggactgatggaatcaaatacttcatattttgtataagcatccttaataaaagataaaacccttatcctttctccataatcttttaaatacataggatggaggagggtttcaagaaatgaagcgtaaacatatgtaggtctgacaataattctaataggggcataatttaattcgcttataaggttccgtatatataaatcttctttcaaaatcaagaatattcttttgaagccttcaataaattctctttcaaattcaaaacattctgctactttatttttgtaaacaggaagattccttccccttttgaagagatattgtttctttcttatagaaattttatctgtttttatatgaagcacttcttctttttcacctttttgattttctgtgtttatcaagcctcctatattagtcagcccattatcttccggaaaactcatatagttaaaaagtgcagattttaatattgttttatttacctgtgctgatgccattaaattaacattttccttgttctcctcagaaaaaaagaggctgctttgaaacagagtctcaagatcaaccaacactggtttatcacgacatgctatgatattttcaaaatgaaaatctgacccttgaaaagcataaataaatcctaaatgcattccaaattggtaataataatttcttacctgttcaatattatcgcacggttcagactgtacatactcttgccacccgtactcaccttgatccaaggataaaggtgtttttaaattagtttgataatactgattgacataatcaatgaccttttcataaaaaacatcaatttcaagtgaacggggtttataaacgagtttgttattctcaaattcaataataacaacacttttaccgccattatgaacatcccctgcattcatattaacctttctcatttttccgaacgaaaagttgaatttttgttggatttttttatagtcattaacccaatgtttaataatagatatagtgaagcgtataaaatcagaggtggatctggagattaaatcttgcaatacaggataattattgagtatttcttcaacaaatgcggagtttttcagcctttctgagaatatatcataatttttagattcatttttttcatcaaactcgtcaaaagtttgatgaaactcatggataagtgttttccccgccaaatagtatatttttttcttataattaattaatatcgattcaacaagacatcccttatccaacagactttcggatggtattctatctatttctttaacaatctgagctttaaaaatacttatataatactgcgcaaaaccttcgaaataatcctcttctttaaaaatattcaacatagagttttcataaacatagttagccgaattctgtgttttgttcacaattatcacttccttatatattcttgactgtctttgacaaaaaagaaaaagaatatgtacgcatatacatattctttttcggatatgtttaatcgttacatggactgacaatggacgcacactttgtcgtcggacagcctgctaaagagattggtattgtgatggttgtcggcgttacggtcatcggggttgcatctgaaccccctgcaaggttttttaattcttcttcagtcattggagtcagtgcttgaaaatcttttttcatgttaattcctcctattgtttgagttttttataaatttcagtcgttacatggactgacaatagacgcacatttagttgtcggacagcctgctaaagagattggtattgtgatggttgtcggtgttacagtcattggagttgcctccgagcccccgccaattcttttaattcttcctcagtcattagttccaatgctaaaaattcttttttcattaaaaatccccccgattgttttttatacttgcctttgcggacatgcgcagcctactgtgatagttggacaaacatgatttgttattggaattgttgttattgatactgagttttgccctccaataagctctcttaattcttgctctgatgtttcatacaacgcgctgaagttctctttcatattccatatttcacctcctttcaagttaataagtctgctggagctgtgattcatatttggtcttaatcgtctttaagtttccattttcaatctcgtagacagattcggagaattcgagccattcggttctatgagtaatagaaattacagtgatatcctttttgtaaatgttatttaatatatttaattctgtatccttatccaaattgcttgttccttcatctataaatagaattcgcggatttttcgctaatactctggctattgagattctctgccgctgtccacctgataaggtaataccattttctccaatcatggtatgatacccataggcatttttataatatcctcatgaatacatgcttcttttgcagcttgtacaacttcttccattgttattttttcattgaaatattttatattatttataatagtgtcattaaacagattgacatcttgaacaatataacctaacgtttctctcagcttaaccatattaacgtcctcgattttgaattcaccgtagcaaatttctcctgctgttttttgataaaggccggcaatgattttaatcaaagtagactttccgcttccagtttttccaattaatgtgattttttctctcggccggatcattaaatttatattattcaaaatataatcgtttccgttgtagctgaaatcaatatttttcaagctgatattatgagcggccgggttaaatagttcaatgcttttatcatttacttcctcatctttttcatccagtacagcctcaaccctgtctaccatttcttcaactaatttaatagactctaaactgccgataattgatcccagcggagacataaaccgtccggcaatgttagaaaaagcaattactgcgcctagcgtaaggcctatagatactgctgaccaagtacccacaattaaaataagtaatggcaaagatagattgattgcattggagaccgcacccagtaaagatgaataattcattcttttagagaaataatctaactgatgattaaagttataatttaattggctctcaatattcctggtttctcctattgtttttataaatgtcattgatcttaagatttcgattagctggctctgaaaattggattgactatttacttcctgttttgtgaacatttcaattttcggaagcaaaattttagtactcatcacctgtatagctgctcccaataaaactataaaagataatatcggagaataaacaaacatgactatgaaaaatacaaatataagactgatatctaatatcaaagtagacgctaacctggaaatgacttcacgaattacagcaatgttatggattctagttgaaatatccccggcagtattcgcctcaaaaaactttaatggaagactaaatattttatgaattattttatcagtcatactcttattaatttttaattgcagtttgataataaatttcattctgattaaggacagactaaagaataatacgattgaaacaattacaatcatgaaaagcattggtatgggaagaattttctcatttccgtcaataaatgaatcaataatatattgagtcaaaaaaggggtcattaagtttaatgcttgaaaaataaaagtgaaacttataataacccccaacaattttttatctttcaaaagatattttccgatctttctaaatgaagacacatcttttaacgacgaagcagtcttatcctttctctcaagttcgttctttctgattaacataatagaaatgccattatagaaggttttgaactcttctaatgtgattgtcagtctgccagacgaagggtctataattttaacgttatctgtgccaaatgcgtcgacaactacaaaatgattatgattccaatgaacaattagcggatggtttttatttaactctttaagctgcgttatattgtctgtgcggaatgctttgaaatcataatcgaatgtttcagaaatccttttcatttctattaaatcagtgccgtctcttccgataatttctttatttaatttcaatttgttaggattgatttttattccctcagccctgctcaaaaccatggctaaacaagtaataccgcaatcaaattgatttctttgaagaataaccggaagctttctttttctaattttcataaatgtctcctaatgtatctacacgtcctatttcaagattgagaatattcggcaattctgcgtctgctgcatacagcattccatatacgatccccgctaaaccaagcattaaattaggtgtttcaacatcccttccaactccgcattggtagaaacctatatttttgtcttgtacactctccaaaatcaagttttttcctatatttacaaattgactttcaccagtcttttttccatattcgatcagtattaaagcatttcccatgtctccgtgacaaagactttgctctcggccaaaaccgtcataaaaaatgttagaaacggttttattcagatcttttttggccacttcggcaatatcagggtgttttgaatctttcaattctaatctgcttaatagaattccaggggatccatggcaccatgcagatgttgcagcttcatttaccgtttttctcagatcaagccagttaccgtttactttttttgaattttcaaaagcaagtccttttcggatgtacatacttatatcttgatgttttgaatgtttctcgagtaattgaagggcatatatcattccagcgtttccatgggaaaaacccgttaacggcttatttgcaataccttcccaagtgacaaaatcctcatcaagaaagatcgcttgtttcattaaaaatgaaccgcattgttcagccaatgataaaaagaatgtatcattctctatttcaaacgaacgtatcattacaataagagccctgctgtgcccccgattatatccaattctttatcataaggaagcaaggacggaataagctgagcgatttgttttgcattctgtttatatttttcgcgtttagtatacatatagaaattcattaaagtatatactattgaagacactccggaaaaagcacctacagacatactgctgtcttcgtccggtttcacctcaatatcaataaaacgagagatgacatctttcataattttttcggcaatgtccagatacttttcttttttcgtgacgcgccataaagccaggtaggtgaaagccatcccggaaagcccgtcgtaaaaggtatcacccataacggataagttccattgaatttcatcaactccaataggagtagcgttaagccaagaatacgaacttcctttatctgtgtgtgctttgtaagattgattataaatataagcggccaattcctctgctttttctattaagatactttcttggttactactgaaaacatttacatattgtcctggttcttttgttataaattctttcaaaacaatttgccgatcatcctccgaagcaagcattgacagttcgataacatagagctgaaactttaaatcgtcttttgataaatttgaaattctttcttttacactttgagctggtgtttccggaaagtaattttcaattttcttattttttgagcttagtaagtctttctcattcaatttcactttgaaataaggtatatcattattaattaaatcgttgaactcatatttaacaatagattgatattcatcttcttgctttggtctctcccatatttttgataagaaaatttctctatcaatagagttgtgtaaaaatctaggatgaaaacttaattctaataaagcagaatactttattgtcggttttgatataaaccgaacatatatcttgttttcgctcttttctattatgcgaatcagctccgaagcatgttttaatatagtcatatatgcttttgaaaaaccttgcttcagttcttcgacataatcttttgcatatacaaatttattctcaagcatagggtgattattagctgtatcaatttcgacatagtctcgtttgacagacatttctgctgtctttaaattgataagctgaggaactttaatgatcgactttgctttccctttccgacctattccgctgatgtcggctttgcccgcaaagaaaaaaggaagcagccctaatgctctgacagattcatgaagctgcgtttcagctttttcataagcgtccatcccatcctttttttctggtatgcaggatgaaataaggattccaaatcaatgagaactggatagctgccgttggcaatgagattttccgaatgaaaatcaacagctttcaatgcatataacaaaccgatttgagctcctgtacgctgataaaagttttgaacatcttttaaacaattgcatgctttaaaagatataaattcagtccatccatatccgtctctgctaaggacattcggagtgctcaattttatatcatgatctctaattttctcattcaaaaattcaattatctttttatataatagatcaatttctaaacttctcggcttataaataagtttaccttcatttaatgttattttagtaacctttctcccatcagaatgagaatcacccatccctacttcaatgtcccttattttgacttgttctgaaaaaccaaataaagagagcagttcaggcttgtccttttcaaaacgggagataaattccagtatgaattttttgaattttctcagttcatttccaatcgctcttaataagactggatatcgttggaaaaagttttcaagatactcctgactgcacaaaagagttttattataatcaccatatttttctttaggagtctcccctgccaaaaaacctttttcccgattcatattcatatccaatacaagtgttctataggatacttttaaaatgattttttctaattgatttgaaatactatgatgaaaaagagccggttgttccagcagatagtcataagaaggaaactttgattttttaagtagatcattgaagtaagaggacacttttaacgcaaaaacgtgaaacatgatttcttcatttacgtcttcttttttaatagcttggtgagcgatccctttttttaggttttcgaaaacatgaactgtaaaagcggatttatgtagtggggtttgatataagcttttcactttatcaattgattgaatggataacacattataaatgctttcctgggccatttgaatatcattcttatagattagttctaagtttcgatcaaacagtttctcattttcatcaaattgagagacagcagcttttttttctttacttaatagaatattagttagcgaattcatttaatattcatctcctttaaaaaaagagggagacagctggatctcccagagcattggaaatctattttcttatttcgggttgttttaacaccagcaagtgtgagtaggacaaagaccgcattcccaagttaacgtacaaagcttaccatcatttccttgagaaatccctcgctgttctgcgcctcctcctccgctgaattcacttaaagaaatttcctcaagttcttctcttaaatcaccggcaaaacgatacattttctcattcattaatattcctccccttgatttttgaaatatattggattttgatccatatatttctataaacctatgataaacgatcttttacctataggcaccgaaaagtcatattcggaaaagcgctttttttttgcgcgtttccgaagtataggttataaagaaaatcgggattaactgttccgttaatcccgattcatttactcatatatagttttcatagaaattaatgaatatcgatttgctttgatcagtgcctctgttctggattttactccgagcttgttgtacacaccagtaagaatgtattcaaccgctctttgactgatcaacagctttgctgataattcccggtttgtcattccctccgctacgcccgctaagatatcttgttctctttcatttaaagtaatatctcttattctatcttcaagcttatcaatgttgaacgtatttgcttctgttcttcttaattgtttaaagagatgagtaggaataatggtatctccctcaatgacactttcaattacttttatcatatgttcttctgttgatgacttacttatgaacccggaaacaccaacttcaaccaaaagattgaaatgcacagagatatcaaaaccagtataaattataattttttgatcggggctctctctaagaatcatttttgacaattccattccatttaactccggcatatataaatcaagtaaaattaagtcatactcataatgcttaaggtgattaagtacttctttacagcaagacaatattgttactcccattttattgcttttttcaagaatggcttttgtcccttgagcaacaccaatatgatcatcaattaatagaatctttatcatgtcagcgctccctattcatttttcgtacttatttcaaaccttaacagcaatccttcatttacgcttgaagatatattatgaataccattcatacaatttatccgctcttttatccctgtcagcccaaaactgtttgtttttgaatttactttattccaatcaatgccgattccattatcttcgtaaacaaacataagacttgtttttttttgaatcatcgtcaaaacaatataactggcttttgaatgttttacagcattagtaagcagttcttgaacaatccggtaaatgtttattgtgatatcttctgtaaaaatagaatcatcttttacatctacaaagaattcaatatcaagctgatagttgcttttatgtttatcaatcaggacttgaatgcttcgaagaagtcccatctccattaaaaaaggtggtcttaaatcaaaacatttttctcttatatactggatattgtccagcaaaatttctcttatgtaataaatatccttgtatttctcaacatgatactctaattctctgcatacaaatatcagctcttgaatgatagagtcatgaatatcctgtgcaagcttggttctctctatttctgaaattgaaaataaaaccttagaaagtacagccgacttacatttatgttgatcgtctatgataatttcatcaatttttttttgaatcaataatttgttctgaagtgcagatgctgtgcagaatgccagcattcgcagccaatctgcctcgttttcacgaatctttatagggtgtccttcatgtgataaatgaataaaaacaaatgtatcacacttctccccgataaacagaattgatccgctggcggtttcacgtatttctcctatcttaaaatttgaaatgtttatgttaggaacttgaatgtttttttctctcaattttaatgtttttttgtcatagtttataagagcaatctgctttcctgagagcacactctgtatttcattggttagttcttttatcaattgatctgcatcggatcccttttgacataattctgaaaaacggaacaggctgcgaagatatgtcttatttctgtcatcataggtaaagcataaacaactactgccgaatatacttagaacaaaaaatagactatactgtttaaactgtaattggctgtctgttataagcaaaagcataaaaaacaataataaggagaaaacaaaagcccttgcaaactgctcaatattaagcttcacccaattatctttcatttgtatccaagccccttactaaggaaaataagggaatccctttgaatccccttaaaatgaaaaagttactttacacttattaaaatataaacagcaaaggcaacaatgtataccagaaatgatccagtcataaattttacaggttttcttgaaaagtttagtacgcctcttaatccgtcattcaaaatcattccgaaaaaggtaaccagtgtaactcctaaagcgagcattgaaatcacaaaaataacttgctccatgtatactcatcctccatttacattctgttttttttcgaatatacgtataatcctgataaggataccaaaacatacagccccataatcagtaatccccaaactaaaagaattgaattggtatatcccatatcactttcagaaatttgaatactgaaacgataaataaaagaaaaaggaaagactattgagacatcacttgctaacagtatcgtcattattaaaaaggaagctacaccggttatcatgacaaccactagatttttacttaagaaagcaattaaagctgcaatcggaatggttagcaggctcaaagtagtagaagtaaaagatgtcgctattaatcttaataagtcgcttgctgagatatcttcccgaaaaaagaaaaacaaggtggataagtgaataatatgattaacagctgagattaaaaacaaaaatagaaaagctgcagctagctttgataatatcaatttgaatttatgatacggatatgacatccaattcaacattgtcctgtttttaaattctaaataaaaataaaaacctgaaaaaataaaaataatagtcggaaataggatcgaatactgattaaaaacaaacatataaaatttgttccaatctgtattttcgttcatagtcaaaagaccgattccgtttatgagaaatggcaaaaagcttagaaagaaaataacataaattgatttcagtcttttaagtttcagaaactcgttacgcactaacagactcatgacctttctcctttgccagcagttttaaataaagatcttccaaagatagcttaaatccgtcaatagacgccttgttaaatccccaagaatttaatttctctttcatttccgacggatgaattattgaaataaactcgaattgctgtttattctttgaaataacatgatccgcaaatttctcaatatccgcccaattaatacccgcttcagctggaattttgtacaaataaagatgttgcgtatttttcataaaggctgactcgaaaataatctgccccttattcataataagcaattcatcggccatgagattaatctcacttaaaaggtgacttgaaataacgactgtggttccatttttcattacctcttggatcaacatttcacgtacttctttaataccatatggatctaaaccgttcgtcggctcatccagcaaaagcaatgcaggagcatgcgcaactgctctggcaattcccagcctctgtttcattcctaatgaagtttgcgaaaacagcttatctttatgttcaaaaagtccaacctttcctaaaatctcatttatttcttcatcagaagctgatttttttaaatagttaagatgtaatttaatattctcaaaaagattcaaattttcataaaagccaggaaattctataatgcttcctatagactgaatcacatcattatttggatttccatataagtcatccccctcaaaaatcacttcacctgaagttggaggaaatatccctaacagaactttaagcaatgtcgtttttcctgcaccgttgggacctaataaaccatatattttacctttttccaatgttaaatttatatcatgtaaaatttctttcttttttatagaaacattgatacccttggatattaaagctggatcagcctttcccacttttcatcattcctctccgtcttgttctgtttataatataaacttacgaggttaaaaagaagatatagtcaaggttaatttacgtttaaatttctcaatataaaaaatacgtgaagcctctacggcttcacgtattcattgctgtttggataaataataaaaaccgttccgttttgattgctctttattttatgttcaagccccatttgtttaagcatcatattaatgatcgataagccgatcccggcgccttttctttcagatttataattcattcccgggcccctatcctcaattatgattacgggtttgttttcaattagctttgtctgtacggaaacgtattttcctgaatgagcatggcgcaaaacattttgaaaaatgttatcaagaattctcttcagccaagtctcgtctatttcccatacgatgttttccttcagatcaatatctattgtgaagtgctctttctcaaaaattggataccaagctgttaacgaagaacgtattatctttaatatgtcacaactctttttatgaagcggcaatttacctgcggcaagaagagaaaatgatgacaaattgtcaatcagttcgcccataaacgttattttatcgtttatgatgcctaaagaatgctttccattttcactgcttatttcattcttcaacgtaaatgtatgccctcttataaccgtaagaggggtccttaaatcatgagataaatcagcaatcaagttttttcggatttcgccttcttcacgctctttttgtctgctgttccttagttcctcaaccatctggttgaatgaatattccacttgacccagttcatccttctgtttaactgttacaaattccggtatgccgtcattatcttgttttttcatatgattccccaaagaaattaaccttttttgtattttcgcaaaaaacatccatgaattaatcacaaaaagtgaacagacaaaaatcaaggcgataaaccatatataggaatacttggccctcataacctcccattgagatcctataattgagcgcggagtttctaaaaatgcatatccgctgtcttcactcccatttacataagcactcagcaataaatatttcttttggttttgttccatcaatttaatcaattcgctaacgtgaataacctcaccctttttggccaaccgttctgagttcgaaaacatcacctttcccttatcatttatccatacaatatcagagtgtttatattgcttcatgtgcgggaaagcagacgtaatttcccgattggatttccctgaaaaaccttccacatcagacttccaatcactttccaacttgtttggttcatagtgtacttgcccctggtgatcaatcaagtatgttaatgtgacatagtaaagaaaattcacacctaaaaaggctatcggaaaaaacaaaattgaggcaacgatattaataaggtattttgttgataatttcattgtttaatcctgtatccaatccctctgatcgtttcaagaatttccggctcatttggattgatctcgattttttgccgtaaatgcctgatatgtaccatcaacgtcttatccccttcgatataaggctgctcccaaatattttcataaatttgttcctttgttaatatttgattgggatgtctaagcaaaagcaaaaaaatccttaactgcttatcagttaaaaatatttcctcatgactttgatgatttaaaattcttttttctttcaagtggacacttaagtgttttagcttcaattcatgaatggcagtcttgtcaaatcttcttaataatacttcgattcgagcggccagttcatcgggatgaaagggttttgtcacgtaatcatccgcaaatcctaagcctttcagtttatcttccagacccgttctcgctgttaaaagcaagagcgggatctgcggatgtgtttttttcatcctttgaccgattgtaaatccatctaaaccgggcatcattatatcaagcacgatcagatcagccttttctatatatgtttcgtaattataggaagaagtgagccatataatcatatagccccgatcttctaaatcatcctttacaaattggccaatttcttggtcatcttcaatgtataaaatgttattcattaggaccccctctgaaatatgtgactaaaaaccaatcttccataataattatatatattataaaaatctcctttatgtaaggcaccattccattattatagctcatagatattcacaattcatcaaggggcaaaacgataagtgaatgcgaaaaggcggtctgttgtcagatcgccttttcccttataacgtcacaccggacttaaagattgcaagctcccgaaaatcgtttttttcgttattgacgtattctccgcttgcaactttaataatgtattgaataaaatctctcacaatgtgatcttctgttgtttggtcttccgccaatctgcccgcattgtaatcaatccaatgaggttttgattgaaataaatcggtatttgttgatactttcacagtcgggacaaatgtgccgaacggcgtgcctcttccggttgtaaacaacacgatgtgacagcccgccgcagcgagcgctgaagaagcgattaaatcattgccgggcgcactgagcagtgtcaatccctttgttttcagtgtttcaccgtatgtcagcacatcagaaaccggtgcaagaccggctttttgggtgcagccgagcgacttgtcttcgagcgttgaaatgccgccttccttattccctggtgacgggttttcataaatcggctgctcgtgcttcataaaatattgcttgaaatcattgatcaatcggactgttttatgaaacacttcttcactcaccgcacgctgcatgagaatcgtctcagcgccgaacatctcaggcacctccgttaagaccgtactccctccctgtgcaatcaagtaatctgaaaatcttcctaataaagggtttgcggtgatgccggaaaaaccgtccgacccgccgcatttcaatccgatgctcaattctgacaggggaatctcctcacgtttatctccctttgccgcaaggtgtatctctttaagaagcgctgtccccgcttcaatttcatctgtgacagcctgtgattcgagaaatttcacccgatctccgttcacttcagaaagcgtttccttaattgccgccagctcattattttcacagcctagccctaaaaccagcacaccgcccgcatttggatggcgaatggcgttaatcagcatttgtttcgtattctcatgatcatcgccaagctgggagcagccgtattggtgctttaaaaccagcacattgtcaaagggggcaatgtctttcgcctcttttacgaagcgctgcaggattttctcagcgacgccgtttacgcagccgactgtaggcacgatccacagttcattccggacgccggatgtaccgttttctcttttgtagcctttaaatgtccggttctcatttgtaaaaggattgtcctcgaagcgcggtgaatacgtgtattcttgcacatcggataaattcgtttgcagattatgggtatgaatatgctcgccggccgaaatccgccttgtcgcacgcccgattgaaaaaccgtatttaatgatgctgccgttttcttcaatggtttgcagcgcgattttatgcccccgctttacagggtccttcacttcaatcgccagtccgtctgtatacagccgctcccctttgttaaaatggcgcatagcgagaagcacgttatcgtttttatggatttttatgacctctttcatttcacttccccccttattgccgcagcattcatgtaacgcatgcttcatcccccgcttatgaatgacagagagaaaaaaagccgttcgttcagtcagccccggaagatggttcagattctttccccacaatcgctcttctcctaatatagaaaatgccgcttgaaacatatcatctttgcaacgggaccgcgccatttgaaaacggttcagaacctcctcgccatctgccggtttgttcagcccgttccagtatgaatagatcatggcgctgaatgaaaataccagcctctcaggaagccggccctcctgttcgatataagccttcagcgtcggcaggtttcttgttttgaatttcgcggcggcgttaagggtgatgctttgcagataatgttggatataagggtttttaaaccggtgtaacacatctgccgcatactgggtgacaccctccatttgcagcacgggaaggatttcttcattgatcagctcttcgatgaatctgcccgtcacctcgtgctcagccgcttcccggacggttagcagtccgtataataaagccactggcgccaatgccgtatgagcgccgtttaagattctcaccttttttgtcctgtaaggcgtaaggtcagacgtgatcagtgcgttcagcccggcatcagcaaaaggaagctcattctgaagctgttccggcccttctatcacccacaaataataatgctcaccgaccacaagcagacggtcttcgtatccgagaaaatcggtaagttcttccgcggtatcaacaggaaatcccggaacaatccgatccacgagggtattgcagaagatgttcgcatcatgaatccattgagtaaaatcaggctccagctcccacagcccggcatattgaagcacggcagccttcagtttccgtccgttttcttcgaccagttcacatggaagcacaatgcaccctttctcggcgtcacccgcaaatgccttatagcggaaataaaggaacgccgctaatttcccggggaatgttttttgaggcctatcctcaagccggtcgcctttctcaaacgtgattcccgcttctgtcgtattggagatgataaaacgaagatcctcttgtgctgccagccgtttaaaggaatcatagtcagaaaaaagatcaatgccgcggctgatggatttgacgatcgtgtgttcttcagccggttttccgtcctttatcccccgcaaaaaaagcgtaaacaaaccgtcctgttcgtttaaacgttttattttctcagagcctctcggctgtacggcgacaacgcttccgttaaaatccgtcaattgattcaattgatcgatctgccagtcagcgaaggcccgcaaaaagttgccttcgccgaactgaaggactttttcaggatattgaatgtattttccgcacatctttttattcagctgccgcaagctgtccgcctccttatatttatgcacacgttaacattctcccgtacaaaaacccggataatcagacgggccgttatgtgagttttttaattgaatctcttatcatcacctcggtgttttcgtatattttttccgccgccgtatccgggtcggtgataagcgccaaaattttctctgcgccgagtatgctgattttttcaaccgggcgttttactgtcgaaagcctcggcgtcatgtattgggaaatgccgatgtcatcaaacccgataacggaaatatcttccggaacgttcaggcctttggcgaaaatggtattcatcgccccgatcgccatatcatcgtttgaacaaaaaacagccgtaggcggtgattgaagcgccaaaagtttttccatcgcctgactgccgctttccatatcatagcggccttttacactgtattcatgcttaatcgggatagaatgatcaattaaagatgtcaaatagccttctttccgctgagaagctgacctgaatccttcctttccctcaatgatcgcgatatctctgtgtccgtttgcgatcaggcagtcgaccgcctgtctggagccttctttatcgtttgacaggatattcgtgatgctccggtcatcaatgtcccggttcagcacgacgagcgggatgtttttctcgcggatatgataaataaatgaattatcactgtcgctttggctcattaaaatgattccgtcatatctcatgggcgtaatggtttcaaagcttttcagatcgtcaatcgcgcggacgaacaaattgtattcctcactgattgtgcggtttacacctttgatggtatcggaaaaaaagctgtgtgaggttccgtttgtgatgcttgtaaaaaacagtccgatcgtatgggacttttgcatggcaaggctttttgcatttacattcggtgtgtaattcagctgtgaagcgagctctaatattttctgttttgtatgctctttaatgtaggggctgccgttaagtgcccgggatacggttgtgtgggatacgttggcgagttttgcgatatcttttatggttaccatcgtttttcctttctttctgtatgctgtcatttatttctattgtaccattaacggacagtccataaaatcactaaagttgaggttttgcatgatgtaagtcctgaacgagctcgtcatgctgccggtccgtcagtttatacattaaaccgataatcagcatggcgcacgctaaagcgaaagccgggtacagcagcagaagccctttaatcccgattaacgtgccttttgtctgagacgcattcgggatatagccgataacgctcagcccgatgcctgaaagaaaacctgataaagattgggcgagttttctggagaagttgaaaagcgaatatgtcgtcgcctccttccgttcacccgtcttccactctccgtaatcaataatgtccgacacaagcgcccacgtaatgccgtttggtatactgatcccgataaaagcaatgctcgctaacgccgtaaagatatatacatttgacgggagacagaaattcagcgcatcagccgcggcgctgacggcaaaaccgatcatcaccgtttgcttttttccgaagcgtttgacgagtttcggcataaacaacacacctaaaaatgaagagccgatgatgataaaactcatgtaggacatcagctccgcattgttgagattgtattgggcgaagtaaacaagcatagcggatttaatgttgtatgccgatattgagaaaatcgtcatgaaaacgacagtcagaagcggtttgttgccgataaagcatttgaaaaccgacatgacggacagcttttctttcggcgcttcacggacgataattctttctttgcagtttcggtagcagatcataaatcccgcgattccgattacggccatcattcccatgactgccgggtagccgatgtgaacgttatcaaaatgaacgagaatcgggatgacgatgacacttgtaatgagcagcgcgccgagagagccgatctggcggaatgcggaaagcgccgttctgtcctccgcatcctgtgtaatggctgcaccgagggagccgtacggaatattgacgaaagaataagcgaccccccacagcatgtaagaagcataggcgtacacaagcttccaggtgacactcacgtccggtgacacaaaaatcaatacggtcatgaccgcaagaataatacttccgaataataagtacggcctgaatttcccccggggtccgatcttttttctgtagtcaatggccgagccgacaatcggatcagtcaaagccgcaaacagcttgctgaccaaaaaaatactgccggcgaacgctgccggaatgcctgcgacatctgtgaaaaacttcagcaaatagatctgcccgagatcaaacataaatccgttcccaaaatctccgaaaccataggatactttttctttcagactcagcttatgctccttcacttttgcggcaggtgctgtcacgacaggcacattactcataggccacctctttcattccattttttaaaagcggaaatattcctcagcattccggtaacaaattccctcgacaatcctccctaaaagctccatatcgcagggcgcttcgccttgttccgcccagccgccgatcagcgtgcagacaagccgcctgaagtattcatggcggggataggacaggaaacttcttgaatccgtcagcatcccgataaaccggctgaacaggcctgtgtttgataacgctttcatttgttgaagcattccatctttcgtgtcattgaaccaccaggctgtgccgaattgaattttccccggtgttttcccatcctgaaagctgttgatcatgctggcgataatatagttgtcattcggattcagagaatacaaaatcgttttaggcaattgccactttttttcggcggaatctaacagccgggcaagcggttttgcgatacattcatcattaatcgagtcatatcccgtatcaggaccgaggctgctgaacttatttgtattggtatttcttaacgcgttaatatggaactgcatcgcccagtccagttcggcgtaaagaccgcaaagatattgcagcgtccgtgttttgaatttcttttcatcttcaaaagacacatgctctccgcttaatccggcggcaaaaatccgggccgcttcctcttcggtcgtctcggcataaaccatttgatctaatgcgtgatccgacactcttcccccggcattgtgaaaaaagcggacgcgggattccaacgcatccaaatacgattggtaggtggtgacagccattccggaagcgctctccagcgaccggacccaatcggcaaaacccgggctgctgatgtccagacctttgtcaggccgaaatccgggcagcacttgaaccggaaaatcactttctttcaacatttcatggtatgtcagcgcatcggcaggatcatcggttgtgcaaatgactttgacatttgatttcagaatgagatcccttgcgccaaacccgtctccctgcaggagctcattcgtatttttccaaattgccgcggccgttttttcattcaatacgtcataaatgccgaaccagcgctgcagctctaaatgcgtccagctgtacagcggattgcctatcgccatcggcaccgtttttgcccaggcgaaaaacttctcttcatctgaagcgtttccggtaatgcagcgctcttcaatgccgttggccctcatgatccgccacttgtagtgatcaccgtaaagccatgcctccgtaatggttgtgaaggttttattttcatagatttcctttgggcttaagtgacagtgataatcaatgatcggcatgttttcagcgtattcccggtacagcattacggccgttttactatccagtaaaaagtcatcacccataaaagctttcacactctcatcctccctcttaaaaaatgttaacgttaacaaaatggttcttttttattttagcttcctctttctcacatatcaatcatttttattttatttttcagaaaattgtatctattaacatttttatgcaaaaaaaagacattgccgagaaaagtccggcaatgtcttctgtatgatcttaaggattagtaagcgaggctgaataatcctttgatatgtgttaaataacgtacgttacttgcttctttcattaaagatgccggaaggcctttcagcggagtagagttcgctccgatgatggcaaccgcgtctttacgtccgaggcttgcaagcgtaccagagtttacaggcttgaatgtttcaagcgtttttccttctaagtaagcgaacaggttgtaaccgacaagttcacccatctgccaagcgatttgcgctgtcggcgggtacggacggccgtccggcgcaaagtatacagcgctgtctccgacaacgaatacatcttcgtgagaagtagattgtaagaaatcgttaaccgtcgcacggccgcggttcacttcaaggccggattcgccgactaacgggttgccttgtacgccgcctgtccatacaaatgtgttggcaacgacttttgaaccgtctttcagatcaataacgtttccttcaacatttgtaacaggaagacctgttaagaactcaacgccgcgtttttcaagactttttgtcgcgcgttcgataaggtcatcaggaagaacaggaagaattttcggacctgcttctactaatttcagtttgatttctttcgggtctacgccgtattttttcgtaaggttcggcatgatgtcagcaagctcaccgacaagctcgacgcctgttaagccgccgccgccgataaggatcgttgcatcagcttcgtttttcgttttagagtattcacgcacacggtcttccacgtgtttgtatactttgttggcatcagcagcagatttcagcaccatgctgttttcttcgagtccaggaatgccgaaataagccgtaacagaaccaagtccgacaacaagcgcgtcataagtcagcttagaaccgtcagaaagggcaacttctttcttatcaactgagaaagaattgacttctgcgattttaatgtcaacgtcttttcctttcagaagtttttccagcggcatagcaacagcctgttcagacacgttgccggctgcaaggcggtgcagttccgtaatgatttggtgagtcgggtatttgttcacaacggttacgcgtgcttcatctttactgtaatgtttgcgaacggttaaagcagaaagaactccgccgtaaccagcgcctaaaatgacaatatgttttgacatcgtatatcctccgtcctttatatcaatttgaatctgagattatttttgtttttcgttcatgatttcaagatagctgttagcaaaacggaacagcttttgagcttgaggatctttcagcatgcgcagcaggccgaaaagtccgatcgtttcattgcttgcatccgcgcggtcttttgcttcgatggcagtagccgcaacttctttcgctgtttctttcaccggctcaagaatttctgtaagcgcacccactgtatcgctcttcaatacttcgtctgtcgctacagactgtgcaaaatcataagacttcgttaaaatatttactaactcagtcagttttggaagctgatccactaaaacagtcagtgattcttgaacttcaggttttagcagctgatcaataagatcgcgttggccttggctgacagatgcatttgtttgatcgattgtttctggcatatccgattctcctttactataagcagtatgctgattttttttggaaagggtagcctttcccccttcatgcagaaaagcatgaaaaagcaagattgtgaattcatgcacaatcatttacaaaaataaatgtttactacccagtttttcactttgccatatccagtattatttttatatcaacaaaaacaattgaataagtcaaaatttctttttcctctctgaaaatagcaaacataaaaaaccccaatttgatttactcttatataataacactttttgaacaaaatttgaacgtgaattgtttcgtttatgaaattatttatatggcgggggtgtaataacgtttcttttaggctatttttttacagaccgtccgcttttcccctgtcatttttcccacaattctaaaagcgggcccgattttcccgtaaaggggtcacattccgggagcgggacacggctgatttcttctgaagttctatcatttttctccgtttttgtatcgtactgccggccgcccggataagccccgatcacggtaaaatcagaactgcccgacagttttttatgtccggtgcctgccggaatgaccgctgcgtctcccgtttgaagaacggcgtccgccccttgttccccgccgaacctcaaaaccgcggttccttttaccgcgacaagaacttcgtgcgtggtgctgtgaaaatgatgatacggaaatactccgcccgtccagctgttagaccaatcgtgccggcggaggacggactctgctttctgtaccgtttcttcattaaataccgctttataaataacaagcggaagattcgggttattcggaatgcggccgtcaccttcgaaataaagcacttgaatatcctctttctgcattgtgttcacctccgtatatgtctgtttcccattcatcatttattaaaacgctattttctcatattccattgcgaagcctgccggtgaatagtatagtataaaaaaatatgtgtcaaaatgagggatttaatgaaagccatcgtgatcggaatattggcatctctgttttttgcagtcacatttattttaaacagggcgatggagctttccggcggaagctggatgtggagctcttccctgcgttttctttttatgattccgtttttatttttgatcgtttatgcgaaaggaaaatgggcgccgctctggcatgaaatccggaaaaaaccgtttttttggctgaagtggagttttaccgggttcgtgcttttttatgccccgattacgtttgcggcggcatatgggcctggctggctgatcgccggcacgtggcagattacaattgtcgcgggtgtgcttctgtcgccgtttttctgcgaaacaaaaaattcaccggcgggcccggtttccgtcagacaaaagatcccgctgatttcgctggttacttccgtcatcatcctgatcggagccgggctgattcagcttcagcatgcgggttctctgtccggccgcacgatactattcagcgtggcgccggtcgtcgtcgcggcgtttgcctatccgctcggcaaccgcaaaatgctggaacaatacggcggaaaactcgatacgtttcagcgggtgctcggcatgacgctcgcaagccttccgttttggcttttgatcgccgctttcggctggtatagagacgggcttccctcaatgggacagacattccaatcctttatcgtcgcactcagctcgggcgttatcgcaacagtattatttttccgcgccaccgatatggtgaggaatgagccgcagaagctcgctgctgttgaagcgacgcagtccggagaggttctttttgcactgatcggcgaaatcgtctttttatccgcggcgtttccgtcacttctttcatttgccggactgttcattattattgcgggaatggtcatgcatacattcgcttcccggcagacagaccagaaaacggcggagcaaacgtcagccaatctcaccggttcctgattttttacgaaaggtgtcatcctatatgaaagaagaaattccggcaatatcttttctgtcagccggcaaacgctttgaacaaaacaatacgtcctttgatgtcctaagccgtgtaaccggacatatccaaaaaggttctatcacggcgttgatagggccttccggcgcgggaaaaagcacattgctgtcactttgcaatctgatgaatacacctgatgaaggggaagtgcttgtattcggaaaagaaataaggcgctgggatatcagggagctcagaaaaaccgcgggccttgcatttcaatcagctcccgtcacggagggcacggtgcgggacaaccttctgctcgcagaaaaactccacggggcgcagcactatacccctgaagagctcgcagattttacagaccttccgcgcgggcttctggatcggaatgcgaaagaattatccggaggtcagcggcagaaactctcattagcgcgaactctcgccggactgccgtccatcctactgctggatgaaatcacctcggcgctcgactcctcatccgttctcaccattgagaaactgattacgaaactccatcggcaaaaacagctgacaatcctgtggatcacccataaccttgaacaagcagaacgattatccgatacggtatggtttatggctgagggacggcttttagagaccgcggaaacgaaaacgttctttaaggaaccgaaacacgaaaaagcccgggcgcttttacaagggagcgggtgctgatatgaatgatctttcactgttactaacaagtatatttgtcattatcgctttattcctgtctaaatcttttaaagccggtgtcgaaaaggatatgatcgtcgcaaccgtcagggccgtcattcagcttctcatcatcggctatgtgctgtcgctgatttttcgcggtgatcacccgatatttatcatattaatggtgcttctcatgctcacggccgcttcgcacaatgtcgccaaacggaaaaaaatgcggatcggctcattttggcgcgtttttctgacactggcaatcgcggaaaccgtgacgcagggacttttactgacccttcacatcattccgttcacttcaagatatgtcattccgataagcggcatggtcatcggaaactccatggtgctctcaagtctgtttttaagccggctcagttcggaagcagacctgcggaaagaagaaatccagctgattctctctctcggaggaacgcctaagcaggccgtccggcagatattgacgtccagtatgaaactcagtatgatcccgacgctagaaagccagaaaacattgggtctcgttcagcttcccggcatgatgacggggcagattttagcgggggctgatccgatacaggcggtgcgctttcagctgctgatcgtttttacaacgatggcctccgctcttcttacatgcatcatactcagcgccttgacatatccttcccttttcacggaacactggcaattaaaaaaattcagcagggaagcgtaagcttttttccctgctgaatggtggtttatgacaaggtcagagattcatagtaacgggataattcaattatcatcgctcccatccgctcaatgtccggagcaaggaccctctttaccccttcatcccggatcgcttcagccgtcactttgccgactgcggcggcaagcacatgtttttcgaatgcctgctgcaattcttttgcggatcctttttcttttgcataatcaaagagagagcgcacttgaatggctgtcgtaaaacatacggcatcgacctctccgtttaacagctctcccatcagtttatcgaccgtctccctttcaggcggaatatgctgatacggcagaacagggaatacctccgctccgtttttctcaaggaactccgttaaaaccggcgctttttcgccatgaagctgtatcataacttttttatctttaaagtcaaatcgttccaaggagcggatcagccctcttgttgtaccgtcttcatctgaggcatgcggcgtgatgccgagcttttttaaggccgcatatgttttatagcctctgcagccgattttcgcttcatgaatggccgctaaaaattcttctttcagaccgattttttccgataccgacaataacgtttccgtaccgatgcctgtggtgaatatcacccagtcggctttttgctcggcaaatgttcttacgtcgggttccatttgatcctccgccaggtatacggttccttggagggaacggatgaccgccgttccgccctgcttttctattaattttgtgatctcttctgttttccgcgaaccgccgatggcaatccgtttcccgttcaatccttttcccatcgctgttttcttcttcccttcagatgccgggcgccctatggcaggccgtcatttatttctattattgttacgcaatcagacgggaaaatcaagctatgctcccgttgaatcccccgtgcagttgctgtatcattaaccggacagaacgatttgattcgcggagggactttcaatcatggaaacaaaaaaagagttcgagacaaaaggatacgatacttcggtcatttatgagttcaatgaatatcctgatgttcacagcggccgatgtgacaattgcgactacacgctgtttaaaagctcagtgaagggcggaaaatttttgagggaatgccggagatgcggcatgaagaaaaacatataacaaaacaggcagccgtccggtgctgcctgttttcctaatcaattttcgacggacgccgttttcaaaaattcttcaatggcgcaaacagcctgttttggaccgccggtttcttttattttctgctgcatgcttttcacgcggctgagaatgtttttatcgccgtatacgttctgaacgtctttttgcagacgggccacagtgacttctttcagcggcagatgcacgccaagccccaattcatccacacgctttgcggtgacctcttgttcgtgcatttgcggaacgacaacgagcggaacacccgcattcatcgcctccattgtactgttcatcccgccgtgagatacgaacagctttgctttctccagcacatcaagctgcggaacgtgctggcggatgataaagtgatcgggcacatccgaaaaactttccggatcaattgttgtgccgactgacataataacccgccagcccgagtcccgaaacgcgtcaatacacatccggtaaaattcaggccaggcgttaaacgccgttcccagtgagatgagcataagcggacggtcatcggctgcatcaatttccagacttcccgtatttgtgcgttccccaagagacggacccgcaaaacagaatcgttcatcaaaggtttcctgtttcggctgaaaggcccttggcataaagacgatattcaatttttcaggcatgaaaaattcttccattgtcatccgtttcacttgttcattttcaattttctcctgatattcttctatcgcctgtttggccgcttccatcgtttcttcgtctcttcctaattgaaaatactcattcattgcataactcgggcagaactttacggccgggatgccgccattatccgcaaacaattttccggcaagcgctaaaaaatcaaacaggacgatgtcaggaaggtcgtctttgtacagctcttccagctgcggaagcacttcaaccgcttcttccagaaacatcacaaacgcgtcacttttgtttacccgttcttttatcgtcttcgggtccgcctttatgcttgtgcggtataaaacgggaatggcacccgttttggcaacggaagcttcaaattcctcagtcgtagcgaatgtcactttatatccgcgattgacaagttcctcggctacaggaagcgtgggattgacatgaccgtgagcggccacattaataatggcgatgtgtgtttttctcatcttttttcttctccctcattttcgtttatctcggcttctaaagactccagcccgtacatgacactgtttcggatcggctcaatccgaacgggctcaaggtgtgaaaaggcttttacaattcctttcagtgcggcttccgcttcaagtctggcaagcggagcgcctaagcagaagtgtacgccgaatccgaaggaaaggtgcggattcgattggcgatggatatcaaatacgcccgccttctcaaatttgttttcatcacggttggcagatgcaacgtagcagagaacgatctctccgcttttcaagcggcgcccgcgcagttcagtgtcgtgccggaccgtccttctgacaaacggagcgggagcgcgaaaacgcagcgtttcttccactgtttgcgcgatgagagaagggtcctgtctcagctcttcataaaggccgggcgtctctaatatgctgtaaaccgcatttgaaatgagattagtcgttgtttcatttcccgccactaaaagcaggttgcaaaacgggatcagatcttctggcgtgagcttctctccctcttcttcctcttttatcaaaatagaaataatatcttggccgggctgttttcgtttgctttctattattcccgcaaaaaacgccgccagctccgcctcacattggtcacgttcctgctgatttttctccgccgcttcaggactcgcatctttcggcatgctgacgagaatgtccgaccattttttaaactgatccatacgctcggacggaacgcctaataattctgaaatcaccatgaccggcaaagggtaagagagatctttaacgatatcaatccgccctttgttctttgcctgtttcaggagatgatcggtaatgtctttaattctcggctcccattccttcaagacacggggagtgaaagcgcgattgacggcagatctgatttgggtatgtttcggcgggtccatattcagcatggactttgcaatcgagcttttcacatcagtcatgcggcttgagaacgtctctttatcactgatgacttttttgacatcatcgtataaaaacacactccaaaccttcgtttcttcatcaaagtatatagggctttcacgtctcattttttcataccaaggaaaagggttgtatacgtccaggccgttttttcctttcatcagggttctttggatggcttgtctcgtgctcctcagcttactcatgttacatcactcctgattgtttcatatttgaatagttgacgtaccttgaattttatcctagcacatattttcaatttttttctattcataaccttaactattaacataacacaacaaaagtcatgaatccggaggtgaaatttctcccaagaaaacagcagaagcgcacaaaaaacccgagccttcagccaggctcgggagaaatgttcactcattcgtctgcggtttctggtgctgcttttggtcttcaggaggctgcgtatttctttccatatcgtccgtatcagcgcccatgcctttcaggaaagaaaacagcagagtgacggccttgttgatttccgggtcttttaaagcgcggacgatatcaaaataacccgtcttcctgccgctgtctttttcttcgacggcctttgtgacgcccgcattgattttaacgataaacggctcaagctgttttacatcgagcatgccgagaacgccgcttaacagcaggagatttttcagcatattggccgtttccggcgtattcgccttcttcaccaggatatccatcactttgtctccttggccgaagagcccgcgcagaagcgccaaaacgccgcgctcgttcatgtgctgaagaatgtgcagagattccaaaatcgcgtctttatttcgtaaaagagccgtctcgatctcttctaagtccttttttcgtttgtcttcttctgtgacggtctgttttcggatgccgctgattgctttagccattctgctgtttccccctttttacggcgtctcccggaaatacataatcttgacgcgcccatttccgatcaacccggacaccgatctgcggctgcgggtttccgtaacggaaattgattttcggaagcggattaacgccttcttttttcaaaatctccatcttcgctgatgtttctttatatgccggtgtatcggtatccttatccgcatagctgcttgtcaaaaggttaatggcggcgtcttttgaatcgttcatcgggagatagacttgtttgccttttaccctgtctgtgatgacgcatttgactttcacatttccgtacggtgatgtcagacggacaagcgttccgtcttccagccctctttcttcggcgagttcgggcgagacctcaaggaacacactcggtgttttttcggatattccttttgatcggtaagtcagattcccttcgtgaaaatgctcgagcagccgcccgttattcacatggatatcatattcttcatcaaattctttcggctcggtccactgaacgggatatagaatcgctttgccgtctgaaaacggaaacttgtccgtaaataaaagcggtgaatcggttccgtccgctgctaccggccattgcagtgaattgtagccttcgagacgttcgtaagtgacgcctacgtagagcggcgaaagcattgccgcttcttccataatgtctgccggatgttcatagcgccaatcagcgcccagccggttggcgatgtccgtaatgatctgccaatcaggctttgaatcgcccagcggttcaaacacttcgtaaaggcgctgcaccctccgttccgtattcgtaaacgtcccttctttttcaagactcgggcttgccgggagcaccacatcggcgaactcggccgtccgcgagagaaaaatatcctgcacaacgaagaaatcaagcttttcaaaggcggcatgaacatggttgatattggagtcgacaagccccatttcttccccttttacatacatacacttcagttttcccgagtggatgccctcgatcatttcatgatttgtcattccgatttctttcggcaggtctgttccccagccctgttcatactttttgcgggctttttcatccgttactttttcatagccggggaagctgtcaggcatactgccgaaatcactggctccctgcacgttattatggccccgaagcggatatgagcctgcgccgggcttgccgtaatttccggtcacaagaagcatgttggaaatggccgtgctcgtatcacttcctccgatatgctgggtgacccccatcgcccacagtgcgcatacgcttttggcttcatgaatcatccgggccactttaattaaggtatccttgtccacaccggtatgtttttccgcatattccatcgtataaggttcaaggcttttcacgaattcatctaatccgttcactctctccttcagaaatgcagtatccgccaaatcgtgatcaagcagatatttcgatacggcattcagccagacaatatctgatccggcacgcggctggaaaaacacgtcggagcgctcggccatttcatgttttcgcaagtcagcaacgacgagcttctgtccgtgcagcttatgagaacgtttaatgcgtgtggacaggacggggtgagactcagatgtatttgaaccgataatcagcacgagctcagctttttctatatctgtaatcgaccctgaatcaccgccgtatccgaccgttctgaacaatccggccgtggcgggagactggcagtagcgtgagcagttgtcgacattatttgttccgataacggctcttgcaagcttctgcatcacgtatgattcttcattcgtgcatttggaagatgtgataaacgcaagcgcgtccgggccgaaatgttcttttatatcggtaaatttatcagcgatcagctgcagcgcttcatcccattccgcctcccgaaacgagtctccttcccggataagcggtttggtaaggcgcttttcactattgacgaaatcccagccgaatttccctttcacacacgtcgaaattccatttgcgggcgcctcagcctgaggctcgacctttaaaatgtctcttcctttcgtccatatatcaaaactgcagccgacaccgcagtatgtgcatacggttttcgtttttttgattctttcatcccgcatggccgattccatatccgatatggctaaaattgatccgtatccggtttcgacgccttttgtgatatcaatcatcggccgaagcgtctcttggttaatgcctgttaaatacccagcttcgccttccatgcctttttccatcatggcattgcacggacataccgtcgaacaatgtccgcaggaaacacatgatgattcattgatcggcacatcctgatcccaaatgacccgcgggcgtttccgctcccaatcaatgcttaaggtttcggttacctgtacgtcctgacaggcttcgacgcagcgtccgcacaaaatgcactgatcgggatcatatcggtaaaacggatttgattcatctttaggatacggtttttgatcgaacggaatgctttgatgattgattttcatttcctttacggtattatgtatttcgcagctcccattgttgtaatcacagaccgtacagtacaattcatggttgtgcaaaatgttgtccatgccgataacctgcgctttttttacatcggacgaaagcgtatcaatgacatctccgtcctttatttgcgcggaacacgaacgcaccagttccccgttaacattgacgatacaggtatcgcacgtttcaatcggcccgagactcgggtgataacacacgtgcggcacgtcaattgaactattgttcaaaagctgcaaaacggtttggccgtccggcgcttccatttcaaccccattgattgtaactttctttgtatcagccattttctttcccctttctgtacccctctatacatcctctatgattcccaaccggcctttcactaaaacatctcgtttatctcaggaaacatacgggtatgagcggtaaaaaggaggcgttcacatgttgaagaaaaaaacactcgtcacgggattatcggcagtgatgctcacgggatgcgctttcggagcagaagcattttcggatacacagcccgtccatgccgcagccgcttcaaaaacggaaaaccagcgtgcacaagaactggtgaacagcctttaccaatcggcatttaaaggggaaatgccgcaaaatgtgaaaggcctgaaaatcaaccaaagcacaagacaggacgtttacaataaaatcggcgagccggaacaaaaagcagacagccgcaatccatttgatttatacagctggaacatgggaaaccccgggtatggattttcctatcataaaaacggaaaaatctcggaaatacgctattttggaacgggggtcgagcggcgcttaaacctcggcagcgtcacacctgacgtcttaagcaaacaaatcggcagcgctgacaaaatcctgacagtgccagaaacgggcgaaacagattacgtctaccatacggggcagtatgagctccgcttcgtcatcggcagtgatcaaaaagcagatcatgtcaacctaaaagccagataacgcaaaaaagcggcctcccgggccgtttttttcatagacagcttctccgtcgttccttacaatacatgggagtacaaaaaaaggggaacagtgtgaagtgaatagacatccattgacatacggaatatgtaccgtttttatcatcgccctcggtttgctgtccagaaccgcatacatcaccgccctattgcccggcatcataaacgcttatttaggagatgccttgtgggcggccatgatttttacaggattcgggcttttcttacggcacatccggacggaaacagccgcaattttgagcctctcgttttgctgtctgattgaatgcagccagctgtatcacgcgccatggattgacgcgatcagaagcagcacgctcggcgggctgatcctcggctggcaatttgtctggagtgacattttcgcctataccctcggggtatgcgctgccgcacttttagaatgggccgtaaaaagaaaccgccagccctcttcataatcggagcacgccgccgatatgaagggataaggaggtggaagctatggatatccctgcgttatcaatcgcaatgcatcagtcatctctggcgcagaatgtaaatatcgctttaacaaaaacggtcatgcagcatgcacaggctgcggcggaagaaacagtgaaaatgctgccgtcccagcacccgactgccggccattcaattgatgtgaaagtgtaaaaaaagatgccggatgataaccggcgtcttttttttgcccattgtacatacaccgtaccgggcatacaggaataaggtaaacggaaccaacatttgaaaaggaggttttcctcttgtacgatcctttcgatcatgaatacacagccgagagccacgaacgggtgccatatcattatccgcggccgccttattattaccccagaccatatccatactatccgcggccgccttattattaccccagaccatacccatactatccgcggccgtatatcccgttctatccttggtattaatgtttgaaaagaaatgactgcagacaggaggcttcccctgtctgctattcaactttgaccgacaggatatacgggagggcttgaactttctccattaccgctgctttcccgcttttgcttttcacccttcccttcacttcaagcaccgccttattcaattcataggacgtaatcagaattcctttttcctcaagagaagttaaaatatcatgcatgacggctttctcttcaatcctgaaactgacagacaaagaatgcgccgccggtttaaacagaaaatttaacagttcaagcccgattaacgccaaaatcgtgccgctgatgccgatgacatacatacctgccccgatcgtcagcccgatccccgacgtagcccaaatccccgcggccgtcgtaagcccccgcacgacatgccgctgcaaaataatcgtgccggctcctaaaaatccgacgccgctgacgacctgcgccgccacccggctcggatcaaaggacgtatggctgttggataacaaatcaaaaaagccgtatttggaaacgatcatcatcaaggcgctgccgacggccactaaaaaatgcgtcctcaaaccggcttcctttgccctgaattctctctccaatccaataagagccccaagcagacccgcaaccgccagacgaatcacaaaatcaagttccatccgtctctctcctttccttatcttcttacccgcttttataacccaatcatgcggtgtatctttttttaaaatgcaccgactaattgacataaggaggttttatgaaatatattctgtggttttttatattattgttatttagcttatttattttgggaggatataaagcagctgtttctcaccctgatttcccggtgccattattcgctatgcacactaaaacaaaggaatatgaaaaaggaaaatacgtttcaaactatacataccgtttcgcaaaagaagaagaaggtccgagcggtttataccaattggaaatagccgaaaaaggctggaaacttaaagggcaggaaggacttatcaaaacctatgaaaagcgaggagaacgtgtttcactttttttcggtacgggggaaataagcgtcattgaagaatgatccttctcaaaagacaggctgaaatccgcaaacggcatatcttttacgactcccttatctctgcgaatctataaattcagccaatatttcaattaaggcgaacacctttctgatgcaaaaaatgccgccttcaatgagaaaatcattatacaaaaacaaaagcgcaactgaaaaagaataagcacctcataaaaaaagccctctttttaaaaaagagggctgcagaaggaaaacaggtaattatttatctaaagtgtactcactcacattaaaagtaagaatgtttccaaaaacaatatggtcccttctattttgaaaaggccctatattattatagtgcttctcgataacatatctagataagcctattccagaacttttttgatcataccatctgataaaatctttaatctcttccattgaaagatcaaattctttctcaagacctgtggtcattgtaacaagaagaattgcccgattactggcgggctgtttatttggtggttcctcaggattctttggttctccatctttatcctcttcggtttttaccggagtaagagcatgcagatattctaatgcatatccagacggcgttagaccgccaaaaagataaagattgtctccaactgcggctattctggcatcatatctttcaaaaggatagggtttttctacgctaatttcatctttaattggatcatatacttttgttaaaggctcaatcacacttggattttttctaccgccaataatgtaaatcttattattaaggacagctgtcgaagtattttgcaaaggtcctaaaaattttttgcgattccatctatccataacaggatcatattcgtaaatatattcgtttagatcgcttctgatatgtccttgaactacttctttagtttgcccgccaactaaataaatctttccgttaaaaacttcagtttctgttgcatatatattaattgggggcgcttttttaacactccaagttttggataaagtatcaaaagcataatgttgcgaatgagcagcatcggtgtcgaatcccccaatcaaataaattgtatcgttaataacagcggctgatgcatggcaagtcggggtcggaatatcaggtacacgtccccatgtatttgttttagtatcataaacatctacagagctgtaaacatttgctcccttataaccgcccaatacataaatataattacctatcactgctgtgcatgaacctaccctgggtgtgggtatatctaatccttgcgtccatttttgacttatggtgtcaaaactataatttttgttatatttttgattacgtgcacctcccaatacataaatagagttacccacaactgctgattcaaaagcataattaggttcaatcatatcaagtaatcttgtccacttgtcatatttctctgtcaatttattcattcctctcatctttgtgataattccatttatagatggcgatcgtatgacaagagattcatttaactaagcgatccaagatcacttactttcgatcaaagaaatattgaaaaaggcctctggatttaaaagtgatttggttttcacttctcggttattggccaacagtttactaaaaatttagtatataagtgtaatatagaataacacctctcaatgaatccttaatgaagctcataatagcttcaaccaaaggcatttcacattaaagtaaagatcactctcaatccaactgcatctctcaaacagaatgtccggcaatcacctcaaaaaacgaggtgaaatctgtcagtatcccgtcacccgccagctgtttttcttcaaatagcgcgcggttttttccgtgcgggtcaatggccataatcttgcccgcacctgcttttttcgccgctgtgagccccgaaaaggcatcttcaatgaccaagcattcttcaggtctgaggcctaacttttccgatgcgatgagaaaaatatccggcgccggttttccggggaagctcccgtcatcaaacgtgactttgtcaaaatcaaaccactgatccaaatgaaagacgtcaaagtaaaactcgacattttcctttaccgtagccgtagcgatggtcatcggcgtttcagattttttcagatgattcaatacgccggtcagtcccttcgtcagctttaattcgtctttgttttcaaggcataattctctgtagtaagcttctttttcaaaagacagcttcctgatttcttcatttgttaaatcgccggaaataaaatacgtcaggatttcactgtttgttctcccgtgaatgttaacgaaaatgtcttcatcagaaatggttttcggcgcgtattttttcaccatgaaaaaccatgctttttcgtgcagatgcgaatcttgaaacatcgtgccgttgaaatcaaaaataacccctttcatcgaaccgcccgccttttttatttttttgcgattttgacatctacatattgctcgtaatgaatttgaacatctttcatgactttatcatccgtaatcagatagtccatatcgtgcaagttatagaacacgtaaaaatcttcccggttaaattttttattatccgccagcaaaaatttcgtccgcgaattattcagcgcgatttggtgagcttccccttcttcaatgctgtaagaagaaatctcatcattatgtatgccgttggcgctgatgaaagccttcgtaaaattgaatttctgcagattgccgttcacgatggggccgacgaaggcaccggtattttttcggaagtcgccgccaatcaggatggtatccgcagtgtcgccatgtttcaaaatatcaaatacgggatagttgtttgtgataatcctgattcgcttatgcagcaggtgtttcgctaaaagttcaatcgtcgtgccgggccctaaaaaaacggtatcgccgtcatttacataggaagctgcgagttccgcgatcttccccttctcctccatttgaacaccgagtttttcattatgcgataattcgtgatcaatggaataagatatgctctgtgcgcctccgtgaatacgtacgatttttccggccttatccagctcgtccagatctcttctcactgtcatatcagaaacttccagttcatcgataatatcactcaccgtaataaaccccgcgagtttacgatatcgatgatttttaaaagtcgctctttttttaacatgttcaatcatcccctcaactttacacacaatctaacatactgcggcaatccggtcaacaaaaataaacattaacaaacaacataatcaacatgtaaaacaacgaaaaacttatataacctctataaacacagatgttatttctttatgaagctattgacaacaaaaatatatgcgtttactattaaacaaaagacaacaattacaaacattaacaaactccaattcacacattggcgaaggaggattcagtaatgctcaaattacctcatgactttattttcggcggggcgactgcggcatatcaagcggaaggcgccacaaaagaaggcggcaaaggccctgtggcctgggatgaatttcttgaaaaacagggaagattcagccctgatccggcaagtgatttttaccgccagtttccggaagatattaaactatgtgaaaaattcggaataaacggcatccgcctttctatagcctggacgagaattttccctgacggcacgggcaaaatcaatcaggaaggtgttgattactatcatcgtattttctcagagtgccataaacgcaacgtcaccccttttgtcacgctgcatcatttcgatacaccgaaaggattatttgatcagggagatttcctcaaccgcgctgcaatagaagcgttcgtcagctatgcggagttttgctttaaagaattcagcgaaatcagatattggagcacgtttaacgaaatttatcccacagccaccaaccagtatttactcggggttttcccgccatctgttaaaagtgatatcacaaaagtcattcaatgcctccatcacatgatggtagcgcatgcgatgaccgtcaacctttttaaagacggcggttatccgggagaaatcggggtcgtccactcattggaaacaaaatatcccgccagcggcacagaagaagaccgccacgcctgttttctggatgacgcgttatcagtgagattcctcctcgatgccacctaccttggctattattctgaggaaaccatgcgtgctctggatgaaatctgtgaggcaaacggcgcttcatacgagttttcagacagtgactttgacgtgatgaaaaaagcctcaacgcgcaatgattatctcggcatcaatcattatcaatgccatttcgtcaaagcgtacgacggagaaaccgttattcaccataacggaacgggcgataagggcacttcggtctataaagtaaaaggaatcggcgaacgaatttacaaagaaggcctgaagcggaccgattgggactggctcatttaccctgaaggcatgtatgacatgctgatgcgcatcaaacgggactatccgcaatataacaaaatttacattaccgaaaacggcatgggctataaagatgagtttgaagacggcatcattatggataaggcaagaatcgactatttaaaagtatatttagaagccgtcagtaaagcgattaccgacggagtcaatgtaaaggggtacttcttatggtccttaatggatttattttcatggaccaacggctacaacaaacgttacggtcttttttacgtcgacttcgacacccaaaaacggtatccgaaagaatcggcctactggtacaaacttgtaagtgaaacaaaaacaatcatttaacgatcatacatgatgaaaagaatctctttccatcatgtgtgccgtctttaggaggtttttttcatgacaaaggaagaattgcagatgctcggttttgaaatcgtcgcctatgccggcgacgccaggagcactttattgaaagtcctgaaagaagtccgtgccggaaacttcgaaaacacggaagcagcattgaaaagcgccgatgaaaatttaaccctcgcccacaatgcgcaaacgaaaatgttagctgaagaagctgacggcaaggacatggaattagggtttattttcgttcacggccaggaccacttgatgacaacccttttgctccgtgatcttattcaggattttatagaactctaccgaagccgccgataaggagtggaaaaatgaacggtatcatcaagcaaatcgaaaagggaaaaccgtttttcgaaaaaatctcaagaaacatttatttaggcgcgatccgcgacggcttcttaactgccatgcctgttattttattcgccagcattttcatcctcaccgccgctgtgccggaagtgttgggtttcacttggcctaaaagtgtttctgaatggctttggaaagtttataactattcaatgggcgccctcggtctgatcgttgcggcaacaagtgcgaaatgcctgagtgaatcaatgaaccgaaaaatgccgaaaaacaaagggatcaaccccgtttcagcgatgcttgcttcagtcgtcgggtttctcattttaagcgtcactcaaatcgacggcgggttctccgcggaatatctcggcacaaaaggtcttttagccgcttttgtatccgctttcataacggtgaacgtttacagattctgcgtgctgaaaaatattacgattaaaatgcctaaagaagtaccgggtaccatttcacaaacatttaaagatgtttttccgttcgctttttccgttttggccatggtgatcgttgatttattgatcaggaatacgctgaatgtatcgtttgcggaggctctctcctctctcttatcgccattttttaccgccgcagacggttatctcgggatttgtgtcatttggggaatgatggcgctgttctggtttgtcggcgttcacgggccttctattgtagagccggccatcgcagctattatttacgcaaatgtggaggcgaaccttcagcttcataatgccggcgagcaggcgtccaacgtgctgaccgtcggactcgggaacttcgtcggcacaatgggaggaaccggcgcaacccttgttgttccgtttatctttctgcttttcgcgaaatccaagcaattgaaagcagtcggaaaagcatccgcggttccggtgtctttcgcagtaaacgaacctcttctctttgctgcgccgatcattttaaatccttattttttcattccgtttgttgtaacgccgatggtgaatgtctgtctgtttaaatttttcgtggatgtcatcggaatgaacagttttatgtatgttcttccgtgggccaccccggcgcccgccggcttgattctcggaaccggcatggggctctcggcttttgttctgacggctgtattaattattgtcgatttcctgatatacctgccattctgtaaagcttatgacaaagtattagcggcggaagaagcccaacataccgaacctgaaaccgcgccgcaaaaatcccgggagatacagcccgtaatggccggcgcctcagaagacgcggccaccgtcatcagcacaaatcttcaggaatcctcatccgccttggaacacggcaccaatgtgttagtgctgtgcgccggagcgggaacgagcgctatgcttgcgaacgcactgaccgaaggagccgaagaatacaacgtgccgatcaccgcctcagcaggcgcctacggatcccattacgacatcatgaaagacttcgatatgatcattttggctccgcaagtcggctcttattatgatgacattaaagaagatgcggaccgcctgcatgtgaaactcgtcgcaacgaaaggagcggaatatatcagcctcaccagaaattcacaaaaagccattcagttcatactggagcatacctcaaaatagaatcggaggtttaccatggatgccaaacttttgaaatcaagattcgaagacattttcaagagaagtaacggagaactgtttttcgcacccggccggatcaacctgatcggggaacatacggattatataggcggtcacgttcttccatgcgcgatcacgatcggaacatatgccgtatgcgcaaaacgcgaagatcaccagatccggttatactcagaaaactttcctgacagcggcattgtctgccttgatctttccgccactgcatacaaaaaagaagacggctgggccaattatccgaaggggatggtccattaccttcttgaagccggcggccaaatagacagcggaatggatattctttttcacggtacgattccaaacggagccggtttaagctcctctgcttccattgaaatgttaaccggttccattttaagaaagttattcagcctggatgtttccgatactgaactggcgcttatcggaaaaagagtcgaaaatgaatttatcggcgtgaattcagggattatggatcaattcgcagtgcaaaaaggcaaaaagaacatggccattctgttaaactgcgataagcttgagcacgaaatgattccggctgcttttaacggatataaaatcgtcattatgaatacgaacaagcgccgggagctggcggcttcaaagtataatgaacgccgcagcgaatgcgacgcggctctcacggaactgcggcaatatcaaaatatcgcatcacttgcggaattgacgggagaagaattcaacgaactcgaacctcttctctcccgtgaaactttgcgtaaaagagcccggcacgcggtcaatgaaaacgagcggaccctctcagcggcggaagctctcaaatcgaatgatttgaaaacgttcggggagctgatgaatgcgtcgcaccgttcgttacgtgatgactacgaagtgaccggtgacgaattagacgcgctggctgaagcagcctggaaagaaggagcactcggagcgcggatgacgggcgcggggttcggcggctgcgccatagccattgtggaaagtgaagaaaccgccggctttatccgggccgtttcatctcactaccgcagcaggacaggtcttgaagcttctttctacatcgcggatataagcgatggcgcggctgaatggagggaaaaataaatcatggcgattctcgttctcggcggagccggctatatcggttctcatgcggttgatcaattagtaaacaaaggatttgaaacgatagctgtggataatctccagacaggccaccggaaagccgttcatgaaaaagccgttttttaccatggagatatccgtgacaaaccgtttcttcgctctgtatttgcgaaggagaacgtaacaggcgttctccattttgccgctcaatcccttgtcggcgaatcaatgaaagaccctctttcatatttcaataataatgtgtacggtacgcaaattacgctggaggtcatgcaggaattcgaagtgaaacacattgtgttttcttcatccgccgctgtttacggcgaacctgaaaaagcgcccatcacagaagacatgccggaaaagccggaaagcgcatacggcgaatcaaaactcatggcagaaaaaatgctgaagtggtgcgataccgcttgcggcataaaatatgtctcgcttcggtattttaacgttgccggcgcgaaaacggacggttccatcggagaagatcatcatccggaaacccaccttatccctatccttttacaaaccgcgctcggtcagcgcgaggaggttttgatattcggcactgactatgatacaaaagacggcacgtgcatccgcgattatgttcatgtttctgatttaatcgatgcccatattctcgctctggaatatttgcaaaacggcggagacagcggcattttcaatttaggatcaagcagcgggttttccgtatcagaaatggcggaagcggcccggcaagtgaccgaaagagacataaaagtaagagcgtccgcaagaagacccggtgatccaagcgccctcatcgcttccagcgataaagcgcggaacattctcggctggaatccgaaacaaacggacatatcggaaatcattgcgtcagcatggaattggcatcggcatcatcctaacggatacaaggacaaatgaaatggaggcggcggtcattgacgtttttgaatcagtggcagggtttctgaaagaaagcactgtcttaggcgacataaatgaaacagatgtgatttatacaagaaacagacttctcgatctgctcggactgacggattatgcagaaccgaaacgtatcaagaaacaaaacaggcttcactatttggacgaaatggtgaaagacgcggtaaaacggtcaatcataaacgatacgccggctgaaagagacatgctgggaagcagaatcatggacgtaatcacaccggccccttctctgatcaatgacgcattcagcgaattgttatcagattgcccgaaaaaagcaacagattatttttatagattgagtcaaaacaacgactatattaagacgcgggccattcgaaaaaatatcgtgtaccgctcaataacaccttttggggaattggacatcaccattaatctatcaaaaccggaaaaagaccctaaagacatcgccgcggtaaaaaacagtccggaaaaccggtatccgaaatgtctgctctgtatggaaaacgaggggtatgccggaacaccgcatcaccccgcccgttcaaaccaccgcatcatcaggcttgacttagcgggagaacagtggggttttcaatactctccttatgcgtattacagcgagcatgccatctttctttcaagcgtgcacaagccgatgaacatcagccgcgaaagcttcagaaggcttctggccattacggaaattttccctcattatttcgcgggatcaaacgcagacttgccgatcgtaggaggttccattctttcacacgatcattatcaaggcggcgcccatgagtttcccatggcaaaagcgggttccctctacccttttcatatgcgtcattttccagacgttcaggccgaagccgtgaagtggccggtatcagtgatccgccttcgcgcaaaagatccggatttgctgacagatgccgctgcgtatgtttttgaaaagtggcgggaatattcagacgaaaccgtcagcatcatcgcgaagacaaatgaaccccataataccgtcaccccgattgccagacgcaggggaacggattttgaaatcgatctcgctctcagaaacaaccgcacctccgaagattatccggatggcatttttcacccgcatcaagacgttcatcacatcaaaaaagaaaatatcggtctgattgaagtgatggggctcgccgttttacctccccgtctgaaagatgagctggcagaagtgaaaaagtatttactgaatgaacatcatgacatcaaggacattcatcttccgtgggctgaaaacatcaaagcggataaagacgtgacaccggaaaatgcagccgctgttttacaaagagaaaccgcgaatgtatttttacgcgcgctgaccgatgcaggcgtttttaaaatgacacccgaaggaattcaggcgtttcagcgtttcacgacgttattggagaatgacagctgaaacattcagagtgaaatcaatcaacaatcttttttatcaggaggtattgtgatgttcaaaaaccgattgaaacgtgtatttgtaaacgcaatctgtctttctctcattttcaccgcttttacatttcttgagaagtctcctaaagcaaaagcggatgccccgtttgcctatggcgctgatataggatggctgaaacaaatggaggatgaaggtgtgcgctggctggatgacggcgggaaacagaaagatgccttgcagattcttaaagatcacggaataaatgccgtgagactgagagtgtttgtgaatccgccaagcagctattattggctgaaagacggcacaacatggacgatgctcggctatagtgacaaagcgggcgtacttgcggcggccaaaagggcaaaagcgttaggaatgaaagtaatggttgacttccattacagtgatgtgttcgctgatcccggccaccagatcaagccgaaccaatggaccggctattcaaacagccagctgcaggcagccgtgtataaccatacgtacgatgtcatgaaagaacttaaaaatcacggcatctctcctgattgggtgcaagtaggaaatgaaatgaattcaggaattttactgcccgacggcagcacgagcgatttcagcaaattgaccggcttactgaacaaaggctatgacgccgtgaaatccgtcagcccggccaccaaggtaatcagccatttagcacacggcacggacaacagcctattcagatggtggtttgatcaattctttaaaaacggagggaaaaccgacatcatcggcgtttcgttctatccctattgggaaggtaagccgtactgggagctcaccggccatttatcatctaatttgaatgacatcgcctcacgctacaacaaggaagtcatggtggttgaactgggcggagatgaaaataatccgaaagattcctactggaccataaaagacaccataaaactggtgaaagccgttccgaacggcaaaggaaccggcgtattttactgggaacccgaagctcactccagcgttctgtcagatgcgtatccattaggcgcaaccgcaaaagtgtctaaaaacgtcttgaaatacacaaccgcaattgacgctttttatgatgccgcaacaggaaaatgattgatgcaattctaaagcaggctcttttcgcagcctgcttttttgtaaggctgcagagttagcctgttatgaagagctaataacgaatacggaaagaaacatactcgaaaaaccacatttcggttaaaaataggatacttcttctgttccccctccttcttatttctgcgcactatctctcagttcctaaataataactttacgattgttgaaaaagaaacaaacattttataatattgtgtaagcaccaccgagcaggaggacgggtcatggacaaaaaagaacagctcctcacggatttcagggacttttttaacaagatggtgtggctgaataggctgaagatggaagaaagccttaaggggcataaaccttctgaagtgcattgcatcgaattcatcgaaaaaattgaagacgccaatgtgacaaaacttgcggagtccctttatatgacaagaggcgctataagtaaattaacgaagaagcttatcaataaaggccttatcgaaagctatcagaagccgcttaataagaaagaaatctatttcaggcttaccgagcaaggaaaagtcatttataaaattcacgaggaattgcacaaagagtttcaagaacgggacaaaatcgtgtttgaacaagtaactgatgaacaatttgacacgatgctgagcttcgtggaaacatacagcaggcatttggattcagaaataaagaaacttggtgcagacatgaaatcggaataaaaccataggcagccctgctccatgaaaacgggctgcctttttatatccctcttattgttgacaaagaaacaaaatcactctattattttgttgacaaggaaacaaatacggcgattttgagaggagaataatatgtcaacacataaaagaaaggaacttcggctgccaaaagaagttctcacagccgcctgggctattgcactgggagcaattgctccaatgcttgactctacgatggtaaacatcgccatcgacaaactgaccaaagacttcaacacgacattggataccattcagtggtccgttacaggctatatgttagcacttgcgattgcagtacccgtatccggctggcttatgaataaatataacggtaagaaaatcttcatcggctcagtcatcgcctttggtgtcatttctgtttttgcgggaatgagccgtgacgtttccagcttcatcttcttccgtttgcttcaaggattcagcgccggcattatcactccgcttatgtcaacactcttggttaaaacggcaggtccggaaaacctgggaaaagtgatggcaatcgtcagcacccctatgatcttcggcccgatcttaggacctgtcatcggaggcttcatcgtccaagtcgcttcatggcattggattttttacatcaacgtgttcatcgttttggttgccgcaccgcttatgatgaaaaccattccagactttgaaccattcaacaaagatcgtaaactcgatattttcgggattatcaatttgtcattaatgagcgcggcattgatgtacggtattacgaaagcggcggatcatgcatcatttaacaatagcgacaccattttatgggcgggcatcggtcttgtttcagcagtcatttatcttgtatataatctgatcaagaaaaaccaaaccgtgctgcctatgaatttgtttgcaaacaagagcttcttagcatcttcgatcgggttgttcttagcgaatgttgccatcatggggccgatgttaatacttccgctgttttttcaagacattcgtcatttcacggcagtcggagcagcactcgctttaatccctcaaggagtcggaatgctcgtgactcgtccgctgatcggaaaaatgattgataagatcggtgcgaaatacgtggttacggtcagtcttgttctttcgctgatcggatctatcccgcttatttttatcaccgataacacaagtatgatttggatttccgtcgtattatttatccgcggcaccagttttggaggaattatgctcccattaatgagtgacgcttatacaggtcttgacagcaaacagcttccggaagcaggtgtcggtattcatatgattgaaaacctcggttccagctttgggtcagctgtgatcgcaaccgttaccgcaactgtcatacaaggattgcagccaacgattccgaacagtttaaaaggctaccatgccggattcttagtatccgtcatcatccttgcggccatcttcattccaagtctgttccttacccataaaaagactgcgatataaagaacttttcaaagtaaaaaacccttgcgcagcaagggttttaatgaatgaaactgatgattgttgccggcagagtcagccaacaacatacaaagccttttactcattcacattgcttttcattaaccattctacttccgttaattcttgtttttgaacgtcttttgtgtgctttttcgtaaaatggactttaacagcttcttcgttttcccaaatctcccaaagcataattttgcgttctgatggttcaagcggatgagcatggaactgaatacagccttcttctttgttcgtttcttcctcaagttttttgaattccttcattatttcattaaggtctttatcactgatgatttttaagcatgccgttatgtaatgcatcgaaactccccctcttcccatcattttatggctttacattataacatcgaaacccgcataccgcattctcaacatataaaaaaccgtccataaaaaatgaacggcaatgtttatttaagatcatgaagagcgacttttgcagcctcagcgataagagcattatgataatcggcatcttctgtaaatcggtttgacaggattgccaaaacaatcggagctctgtcaggcggccaaacgatggcaatgtcgtttcgcgtcccgtaacttccggctccggatttatcgccgacttcccatcctgcaggagcgcctgcccgaatcagttcatcgccggtagcgttgccccgcatccaatccgttaagatcgtgcgcttgtcagtcgtgagagtgttacccaaagtgaacgctttaagatcggttgccagtgcctttgctgtgcttgtgtcacgacgatccccgggaatcgcagagtttagatccgtctcgaatcgatccgctttcgttacatgatccccaatctgtttcagtgatttttcgaaacctttagggccgccaagctgctgcagcaataggttccccgcagtattatcgctgtaacggacagcggcttctgagatttctttcaggctcatgcctgtatccaggtgtttttctgtgattggagaatatgtaactaaatcgtctttgctgtagcggatgatggcattaagtttttcatttgagcttttcttcagaacagcagctgcagccagaactttataggttgatgcgtaagcaaaccgttcattcggccgataggcgattgtcttgtttgaccccgtatcaatcgcataaaccccaagcctggcatcaaattttttctcaagctgaacaaatttttgattcgttatacagcttgtcatttttgtgttttctatggattttgcttcagcgtgcgtagagccgaataaagggctgaaaccggtaaagcttaaacataaaagcccaatgcatattccaacttgtattcccgctttatttttcacatccagacctcctcattataatgtttttgtatacatcttctaattaacattacaaacaggatgaaagtcaatatatttcctgtgaatgattaaatcctgcattctgattcctccccttattaaatgcgccgcccttgccgcgtctgaatgtttgcatgtccgcttcgtgttcattatctatttgttatccctccgtgcaaataaaaacggacaccaatcagagcatagtgagctgtgcaatgatcagtgtccgcaggctttccgtcttggatctatatatgtttctcttgcagactataaaaatcataaggtaagttaacaaacgcattaccttaatctcgcggtcaaaattatatcattttatatatttcaataagattattatctggatctctgaaatgagcaactcgtgcacgccattcctgacgatcatgtggttcattgacgcatgtaatcccttgcttgtgcaaatagtcatacgttttatcaacatcttctaccttaaattgaagcaaaaatctcgattgcgaatctccgtctaaagattttctttcttctccaactatttcagccatattttcttgagataaaagctctattttcgtttctccattatcgaaaagtgcatattccatttccttctctaaccaacttattggaagtcctaatgaatctttataaaactcgacgctttttttaaagtcattaaccaatagtctaatttgcagcagtttcatattgaacgcctcctatcattttactggccattcatttaatcatacaatagggacctgacagcattatgtcaagtttccacaaaaaaatttcccatactgcacccaaatttcggatggaaagccttcgaagattcatgaaactgcgtttgatcaattcacattcttagtttgaattctcctcctctccaccgtggaggctccggccgtgtaagtcgcgcacccgtaaacatccggcccccgctcccataagtaacacaactgataaataattgactgagtcgttttttcaccgtcatcgcttcccctgttttttatattctgcgatttccttaggggtagccttccggactccgtctgtgtctgtcctgtttgccacttgagcgccttccatgttttttatctcgctgacgactcccaaatgctctaaatacacatgatcaccaatcttgaaacgattcagtttggcccgctcctcggtcatgctcctgtattcagtcgcggctttcatttttaattcagccagacacatttgacaaagtgttactgttacagaattgccgttaaaatcagtaaacgaaaccgatctgacagattccttttccgggtgcatcgtacatgttttcttcataggtgaaggccgtgtaaatttaatcattccgcttcctcctcaaaaaagtcttttcgtccctctgacataactcggatgaatgggaagttccgtacccccgcattcgaactgtcacaacacatggagattgcctttccttcgccgtctgacggattttcatccatcctgcatagctgtaagcctatattcctttatattcccaatgcccgccgcacttccctgttatgatgaagtttttaaagctattgaccagttgcccaggttgattccatgcggaaagcagtttgggccgccgtatcctaattcattcgggtaaatttcagccctctaatatgtgtgtgtatgctttttaaaggaagtgcgtcacatgatgttctaacaaccgattcaacctaaagctaactctaccccaattcccgatcataaaataagtaaatttacccagaacaaattaatcattttgcactttcaaaatacttatttggcttttccttcattcttccatggtaatatcttgttgaagtatttcgcatgaaaggatatggtcatgaaagttttcgaagcaaccaccctcctcgccgccgccaaacagcgtgcgggtgaatataaaaaactgcgcggtcagatggtcaacctaaaaaaagcgtttcaaggtatggctgatcttggtgacaatgatttctcaggccggggcgctgacaatatcaaagcctttttccaggatcacgccggcgtcacagacagctggcttgatctgatcgatatgaaaatcgcatttctcacaagccttcccggcaaagtcgaagacgcaggtctttccgaatctcatgtagaagaatcttttctggagcacgagctcacccatgccctcagtaaatcaaaggcgattatggaagcgcagaaaaaagacatgcgctccatcctcggtgagatcgaagacatcatctcgctcgaattgttttcaaccgaaagcacagatcaaaagctttcttcagctgacaaaaaaagaagcgaaaccatacataaactcggcaagcttgatcacgatctaacgaaagaatacgcagaaaccgaagcgaacgaacagtttatccaagccgactttcagcagctccaaaacgccacaggcaaaggaaaaagcgccacgccgcttcactacaacgccaaagcgtaccgtgaaagcgacatccataagaaaaaaggcgatatcgcaagacattcggatgcttatttgacgattaaaaaggaagaagcgaaagagcgtgaaatcaaggatctgaagaaaaagctggctgatggtgtcaccgatccggatgagtatttggaaatcgcaaagaagatcggctatgaaaaccttgaacccgctcaggtggaatatgtaatgcagcttgaacaagcaaaacagcttgaagaagtcggagaaacggcttgggatatcgtcaaaggaataggcgtcggcctttatgatgtgggaaaagacaccataaccggcgtcaaagatctggctgtcggcgcatgggatttttaccatctctccgatgaacaaaaagtcgctaaaaccatatcggctgtattgaacacgccctcctacgcaaaaatcatatggacaaacctggcggattcgtggaatgataaaatggttaacggggatgcgtattcaagatcccattacatcacttacgccatcgggagcatcgtcgggctcaaaggttccggctcagctgtaaaagtatcaagcaagctcgcgaaaacaggcgccgccaaagtggataacgtcttggaagccggtgaaaaagcagctgcaaaacatgtaaaaaccgggattgaaaaaggaaaaaattatatcaattccgtttcgaaaaataagtaccaacccgcgcttgccggaatagcacaggatattgaaaatactcacaatgtgaagaatactcctttgttgaaaagtattattgaagatcagaaagagagtgtgctcagtaaatctgtgacttctgacaataacggcatacatagtgttaaacaaggagacagcagtcctctcgcaccaggcggtggcttagctgctcacgaagcaaaaggcggacaccttctagaaaggcatgttgggaagactgatgaagagttattacagaggctacagataaacaagaagatacgtgcctcttctagtttcactgataggccaactgcagaaagagtcgctaatgaaacattaactaaacataaaaaggaaattgaagagtggttaaaaagtgatgttaacgatccattaccgttaccttatagaggaaccgaagttataggtagaggagttcgtaaaggttcaaatgaagttaaagatatgactaatgctagaatagtattaaagaaaaataaagatggtagctttatactaacaggctacccaacgaggtgatatataatgattgaaattaaagtttctgatcctgtatttagatttctcggcggacattttcaccaagatatagagtctccggaaaatgcacttgatgaatatttaaatgaagcatcacaaaaactaaaagaaagagatttaatagcactaactgagtttgtaaatagtgattattcagaagaagacaagaatgaatttatagaggaagcagcggatggtatatactttcctgaagatgatataactccattagaatggcttaagcaagtcactgaacaaattaaaaagcatcttaaacaacatagttagaaaaagagccctcttttaagaagggcttcttttattaattcaatttcgctttcgtttttggtccgcaaattccgtctggcttcaaaccatacatgagctgaatcgtactgaatcgttcagccgcatttactgatgtaagtgaatttaaataaattgcaaaaaaaccctcctcatcttgagaagggctctgacttatacttctttttctctaaatcagtccgaagcaaaaaactgatgccgctcaacttttcaatcgaagtgcttcagcgggttctccaactatttgcccctatgcttttcttttgctttttgttttctgattaaatattcttgttcctttattttttctctttgttttttcttttcttttttcaagctcctgttttattgcattttgcgccttagttgatatcccgatatttttcatctctttagaagcttgtcattgcaatctttttggatttaatttcttagattttgctttaacacaaccccttcttgttcagtgtgggagagagtctgtaaaaaaggaaagagtctccgcttattttaacaacacttcaagttttgctttggttcaagcgcataaattccatcagcttttaatccattcaccaattgaaatcgaattactgcattcgctgttttcgctccatatgctccatcaatcccgaagttcttccgctttaataaagggccgacagcgccgttcgaatctgttttacgctctcccctcgggttttaatgggcttttgacttaaaaaaccggaaagcaaggggaagtatgatttcttgccttaggatggagggccccctgtatcacttctttatcatcgacggcaaaatgatatctagtcgattcactgctaccggtcatataactgatttcattagcggctgcatgcgtcatttcctgtgctgtgaatgatttccagattttcgctgtatttttcatacaaaactaaatattccgtttttcaaatacaaaaaaacagcaggattaaccagctgctgatcgttatcactttagccgttcagtgatacggaatttctgtatttctctgtaatgaacaggtttcggcaaagaccgccgccttaaaggcgatgttcacctcccttgaagtatacagcgaatgtacttcaaaatcggcccaaaaaagcagttccgtccccaattcgtccccaactcgatgaatgatgacaaaatcaataaataagcaaagtaaaaaacccttgcaacgcaagggttttggctatgattccgactgggctcgaaccagcgacctctaccctgtcaaggtagcgctctcccagctgagctacggaatcatgatatgtatgtgttgctgggtatgttgttgtctctctgacatttataattatatatcctgatttctcattcgtcaacactttttttatctaaaataaaaaagggcgcgtcgcaaaattgacggcacccttttcgtttatgatctcacttgggcgggggttatttttttcaatgcctgttcgaagtcgcgttctaaatcttcggcgttttcgactccgacgctcaggcgcagaaggccgtctgtgatgccgcgtttttccctctctgatttcggcatggcggcatgcgacatggctgcagggtatgagagaatggactcgacagcgccgaggctgacggcaaataccggaagcgatacgttttcgaccagctttttgacggcttctttgctttccaattcaaaggacaggacggcgcccgctccgctcgcttgacgtttatgggtatcggctcccgggtgtccggcaaggccgggatagtaaacgtttttgattgcgggatgcccgtcaaaataggcagccagccgctcagccgtccggctcgctttttccagtctgacctgcaatgtttttaagcctctcaatacgagccagcagtcctgaacaccgagcaccgctccaaacgagttttgcagcttatacagctgattgccgagctcttcatcttttacggcggcaaggcctgacagcacgtcactgtggccgcttaaaaatttcgtcgcgctgtgaagcacgatatctacaccgagatcaagcggacgctgcagagcaggcgtcatgaatgtattgtcaaggtatgtcagacagccgtgttcctttgccagtttgacgacgcccttaatatccgtgatgccgagcgtcgggtttgacggtgtttccatataaatggctttcgtgttcggccggatggcgcaggcgaccgcttctgtgtccgtcatatcgacaaaggtatgttcgattccgaaacgggacagaacctcagtcaccatgcggaatgttccgccgtacacatcctccgtgacgagaacatggtcgccttgggataagagcagaaacgccgtcgaaatcgccgccataccggagctgaaagcaaaacctctcgttccgccttcaagacctgcgatcgtttcttcaagcgctgttcttgtcggtgtgcctgatcggctgtagtcatatgtcccgaattcttcaaatgaagactgatggaatgtggaagcatgctggatcgggacgctgacggctccggtggctccgtctgttttaaatggattgtgcacgagctgggtttccagcgtccaattgtgattactcatatgacacggccccctcttttacttgctgtaatgcctgctttacatcccgcttcaaatcttctgcatgttcaatgcccactgaaaaacgcagcagacggttgcagacgccgtttgcgatacggatatcttccggaatgtccatgtgcgtctgtgtcgcggggtatgtaataaaactttccaccccgccgagactttctgcgaaacagatcgttttcagcgcctttaaaaacggattgacccattcttctttttgcagccggaaagacagcattccgccttttccgggatataacacgtcggcgatttcctcttcctgttctaaaaattctgcaagttcaagggcgttttcttcatgacggcgcattctgagtccgagtgttttcatccctctcattaaaagccacgaatcaaacggcgggagaacggcgccgatcgcattttggtgattaaacatgatgtcgccgagctcttcatccttaacgacagccagaccggcaaggaggtcattgtgccccgctaaatattttgtggcgctgtgaatgacgatgtccgctcccagttcaagcggacgctggatgaccggggtataaaacgtattatccacaatcaaaagcaggccggcttctttcgtaatccgggcgattttttcaatgtccgcctcctgcattaacgggtttgtcggtgtttcaacaaatagcgctttcgtgttttccgttattttggagcgtaaacagtcttcatcgctgaaatcatcgtaaataaagcttaagccgtattttctccattcgttttcaaacaaacggtacgtgcctccatataaatcggaggatacaatcaattcatccccgcttttaaataaagccataatggtttgaatggctgccattcccgagctgaaagcaaatcctctcgcaccgttttccaacacggcgatggcgtcttcgacgagctggcgtgtcgggtttttcgtgcgcacgtaatcaaaacctgtagattctcctattcctctatggcggtaagcggtggacagataaatcggcggactgaccgttcccgttgcttcttcgcttctatttccgatttgggctaattttgtttcaacatgctgcgtcatcagtaagcaccatcctttttcaaaaataaaaaagccccctcttcataagaagaaggagcttttctcttcctcttatcttccaagcgtgaatcgcttgctggatttagcaccttggcactttgccttcccgcggcaaagcaaaccggttgctgaggtttcaaagggccagtccctccacctctcgtgataagaatattgttttgtattttctgattgttctatattaacgcactataaaatagatttcaacaactttttatttatctgaactctcgcaagaagtgcatctgaagaaagaaatttctaataattcatggtacaataggaaaaaaccatcaagacaagaagcggcctggaggaatgcgaagtggcatcaaaaaacggaatcattcatgagaaaacacttttctcccatgagcttgaagaggaaatgaccgttttggtctacctgcccgccaccttctcccccctgtataaatatcatacggtcatcgctcaggacggccatgattatttcagattagggagaatcgggcgtcaggcggaagagcttatgtcaaaaggggaaattgaccgctgcatcattatcggcgtcccttataaaaatgtgcgggagcgaagaaacacataccatccagaaggctctaagttcgcctcatataagcggtttatcgccaatgagctcgttccttttatcgacaaagaatacccgacttatcaagtcggatacggccgcaccatgatcggggattccctcggcggaaccgtttcgctcatgacggcgattgactatccgaatatgtttggaaacgtcatcatgcagtctccgtatgttgacgggcacgtgctggatgccgtccggcagtcggaggatctcaaacagatttccgtttatcatcaaatcggagaaaaagaaaccggcgttcacacgacggacggccaggttcttgatttcaccgcgccgaacgaagagctcaaacagctgctggaaagcaaacagtctgaatacacgtatgaaaccttcgacggggatcataaatggacctactggcagccgctcatcacgccggcgctgaaaaaaatgctgtaaccattcatttaaggagggaactttcatgaaatacggtattgttttatttccatcaaaaaaattacaggatctcgcaaattcgtaccggaaacgctacgacccgagctacgcgctcattccgccgcatctgacggtaagagatccgtttgaagcgacagaacaggaaatcgagcaggtcgtatcacagctgagacagacggcgaaagagtcgcatccgctcgttctgaaaatcacaaaatacagctcgttttctcctgtgaataatgtgatatatatgaaagcagagccgacggaggaattaaaatctctgagtgagaaatgctactcaggagcattatccggcgagccggaatacagcttcgttccgcatgtcacggtcggccagaagctgtcgtcagatgaacattccgacgtactcggacagctgaaaatgcaagacatttcccacgaagaagtcatcgaccgttttcacctgctctatcagctggataacggctcatggactgtgtacgaaacatttttattaggcggaggagaataactgcttggaatccatcatcgtaaaaactgaaaaacagctgaacgacgcttttttcgtcagaaaagaggtctttgttaaagaacagcacgttccggaagaagaagagattgatcaattcgaagacacgtcagagcatatagtcatatatgacggcggccagccggtcggagccggcagatggcgcttgaaagacgggcatggaaaattagagcgcatctgcgtaatgaaaagccatcgttctttaggcgtcggagccatcataatgcaggcgcttgaaaaagcggcggcagccaagggcgccggcagctttatcttacatgcgcagacgcaggcggtcccgttttacgaaaaacaaggataccgcgtcacatccggcgaagaatttctcgatgcgggcatcccccatctggaaatgataaaggaatacaaacaataaaaacaaaagcactcctgttgatatggcaggagtgctttttttatgaaaacaataccgtttcatgaattttattgcattttatggaaggttaatgtatgtttagtatacgaagtattacaattcatacaaaaaatacaattcatatttcggagggataaacatgacggcaccaaaaggaaaacacatattcgggactgttaaagtgggcacaaaaggacagattgtcattcctaaagaagcaagagatgttttcgatataaatccgggggattcactgcttatgcttggggatgaccagcaaggtatcgcacttgttaaacaagaactctttttcgagtttgcaaaagatattttaaacgctaagcaaatcgacgcagatagcgaggatgagtaaatgcacgcgattgagctgaagcaattaacgaaacattataaagaaaccgccgccgttgaccgtcttgagttctcagttgagaaaggggaatttttcgctttactcggtgagaacggagccggaaaaacgacattaatcaatatgctttgcggactcctttctccggatgaaggtgatgcatcagtgcttggacacagtatttcgactgatttggataaaataaaaccgaaattgaatatgtccccgcaggaaacagccatcgctcctcatctaaccgtacgggaaaacttagagtttatagccggagtctacggaattccgaaaaaagaagcaaaaaaaagaacagatgagatgctcgaattgtttcaattaaaagagaaagaaagagcaaaaaccaaaaccttatcaggaggaatgcagcgccgcctcagcatcgcaatgggcatgattacgaaaccggatatttatttcttagatgagccgacattagggctggacgtccgttcacgccgcgagttgtggaaaaatcttgagacattaaagggagacatgacgattattttaacgacacactatttagaagaggctgaagcactggcagaccgtatttgcattttagaaaatgggacattaaaagcactgggcacggcggaggatctgaaaaaacaaactcattcagccacatttgaagatgcctttttagcgatttgtgacggagaggcgggtctttatgcttgatttcgccattcgcaaccgcaaagagatttttcgtgatcccttatctatcatccttggaatcgcactgcctgttattctattgtttctgtttacggcgattgaaaaaaatgcgccgcttgatacctttaaaattcagcatttagcacccggactcattgttttcggtttcgctttccttacgatgttctctgcattgctgatcgcaaaagacaaacagaccgcccttttgacccgtttgtttgcttcccctttaaaaacagccgattatgtcatcggttacgcactgccgatgcttccgttagccattttacaaatcgtcatttgttttatcgcagctgctgctgccggtttatccgccgagtggatgaatcttctcgcaggtatcgctgtcttgctgccgattgcgatgatgtccgttttcttcggtttatgtttaggggctgtgtttacggacaaacaaatttcaggtatcggaacgatttatattacactcgtgcaatttctgggcggggcttggatggaggtgagcctgctcggtgacacattcaaacatatcgcttatgccttaccgtttatccactcgatcgagctggctcaggaagtcatatccggagattattcttcctttcatcagcatatttggccgatagcgggatataccgttttggcgcttgcacttgctttcctcagttttataaaaatcaggaagagttaaaaaagccggcactccgtaatgggagcgccggtcttcttttttacgtttctttcagaaggcttatcgtatgcggcagcagacggtcatcccccggactgccatggcccggaacgacaatgctgatgtcctgatatcttttcatgactttgcggacggcgcgcggccactgatccggataaaagcccggagttggtatgatttcctttgtttctaaagccttgattaagcaaccgccgaataagagcttatcctcaggcagccagacggtaatattgtcttccgtatgcccttttcccggataaaacgtttcaattttcatatcgccaaactgcagctttgtcacgtttttcaaatctccgagcggccggtcatatccctgctgccgggcgaagtcggcggtcagcttcgtgctgtgcacctttacaccgtatttgtacagtgtgttcagcccgccgatgcgatcgtcatgggcgtgtgtcacaatggcatcggtcatccttttgccgggaaaccgctgttttatttgtgtcattaattgctctgtgagactgtcattccacggagtatcaatcagtacgattcctttggaagtttcaagaagcaatccgttcgcagggacgggacttccgtctgccgtaccgatgcttgtatgcatccagacatgcggcgccagctgtgtgagagtgacatcttttgctgcggagctctccgccgcgtgtgccggtttcattccggcagtaaagaggccgaatagaaataaccccgcaattaataatgaaagctttctcaaattgaatcattcctttccgcatctttcatatatacggctcaaaaaaacccggagatttccgggctttttcacacatattgatttatcaaccggccttttcccataatttgcggcagacgggaaagagagcgcttacgtttttcctcatgcattttcttttctgcggctgcggtgttttcctggcggcgctccacctctctgtacaccctgtcattggcgagggcggccgctttcgtaatgccggcgtaatcaggcttataacccgctgcccggtttgcgtattgagaatactgctggttttgaatccgtcctgcataaatcatatgtacccctccccttcgcttttcatttcccttaatcttactttttgaaacgcggttcttttgttatgatattctttgtctatcaaatggatgaacaccttttaatgggaggacccctttttgaaatgcgcccgactgaataaccgaacgatacatttacatacatattctagagaacattaccaattcctttttgaagaagctcagaaaggaaatattttttgcgcacattgtgaccagcctgtcttgatgcggctttcgattttagagcagccggcattttatcaccggcaaaagggagacttcaccgcctgtgaaaaagcatgcgccgccgaggaaccacaagcggagaaagaaaaagaagagtataaggaggcaggcatgttccgcctgccgaaaggaaaagcgatttcagagaatccgaaaccgatcgtctcagaatggaaaagcccgaaaaaagtgcctgcggccgaaccgttttcaccaacatccgaggcagctgatacatctttgttccccggcatcggcctgaaccgcgaacagatgcgggcagtcacggaaacggacggccccctgctggtgcttgccggagcgggaagcggaaaaacaagggtgctgacagcccgcgccgcccatatgattgaacacctcggcatttcacctgagaatatgctgcttgtgacctttacgacaaaagccgtcgccgaaatgaaagagcggatggcgaatgagtacgggctggcagccggaaaagtctcccgtctcgtgaccggaacattccacagttttttctataaaatactctatcattatgattcttcaaaatggaacggcagccagcttttaaaaatggagtggcaaaaagagcaatatgtgaaaaaggcgctctatgaagaaaatttggatgaaaaagagtttcccgtcgaccaggcgctgcagcttatcggctgctggaaaaacacgtatctcccccatgagaccattccgcttgcggacgactgggagaaaaaagtgtaccggctctacgaacattacgaacggcagaagcgggaaaaacggcaatttgattttgatgacatggcccaaggctgttatgaactgtttcaaagccggcctgatattctcgcgcagtaccaaaacagattttctcatattttgattgatgagtttcaagatattaatcctgtccagtacaacattatgcaaatgatcgcaagcccggagaataacctgtgctgcgtgggtgatgacgaccaatccatttatgcgttccgcggcagcagcccgtctttcattcttgattttcaaaaggattatccggcagcaaagaccatttacttaacggcaaattaccgctcgccgcatccgatcgtctcaagcgctcatgccgtcgtaaagaaaaataaaaaacggtatgaaaaaacactttctgccgtcaaagacggcgttcacaatcccgtgatgttttatccttacgatgaagaagaagaagcgaccatgatcgtttcggatatgaaagagaaaattcaaaacggggcgagtcctgatgattttgccgtgctttaccggacaaacagcgccggacgggccatttatgaaagactgcaccaatcatcgattccttatcatgccgaccgtggcgtgcagacgttctacagccgcagaatcgtacgccagatcctcgcctacttatatgcgagtcagaatgaagatgatacggatgcggtgaaagatctgctgcccgccttatttttaaagcaatccgccctgcaaacgttaaaggcgctgtcaatcacggaagattgcacgatgattaaggcactgacgaaactgcctgacctgaagccttttcaaataggaaagatcaagcagatcgttccgtttttcgcaagcatccggacaatgaagcccgttgaagccatcacctttgcagaaagcaaaatgggtttttccgagtatttaaaaaaacggggcaatgagggaaacaaactggaaaaaggctctgatgatctcagggatgtcaaagtggccgccaaaaaattcaaaaccattcccgattttcttgcgcatgtcgatcatatgcgcgccgctgagaatcagaaaaccgatgaaaacggcgtcgaactgctgaccattcaccgctctaaaggtcttgaattcaatacagtctatattttaggcgcggctgacggctcgataccccatgacttcgcgcttgagacagcgagacagggcgatcccgctccgctcgaagaagaaagacggctcctgtatgtcgccatgacaagggccatgcagcatttatatgtatcttgtcccgcgtacaggcggggaaaaacagcgcgcagctcaagatttctcgagccccttcttcggacggacagacggagcgcactcaggatataaagaacccggcagatcactgccgggttcttctcacataaaaaggcctttttagcaaggccggctgacgcctatttattgtttaacattttagaaatggtgccaaaatcaagtttctctttaccgcttgtaatcgattgaacgattttgtcttccaattctttcggaacacgcttgttagccagctgggacaccttctgaatgacgcctctcaccgtgttttcatctttgaaattggcattttgcaatgatcctgcaaggttcatgacatccttcatgctgacgcctgttttcttctcaatatttttaaaaaattgattatccatggtgtgcctccttttgtggagtaatacgatattgtatgaataaagggcggaacgtgtgcccgtaagacaaggaaaaaattccgcatctccttctctatccttcatacattagggaagcacgggactgaacggtcccgcgcttatccaaagtcttgctaaggtttagccaaaaaaggatgcaccgacaatgatcagaaggatgaacaatacgacaacaagaacaaatgttgagccgtatccgcctccgacatagccgcctccgtatccgcagccgccgccgcagccgtaaccgccgtagccgccgccgaatccgccatatccgaatcccatatttaagcacctcctttactctctatactctatgtgagccgacttgtttggcttggataaatgcatagggccggtgcggatttcttttcattttattgagaatgctcatttttcttcagtttcgcttctgtttcggcggcaaacacatctatccattcctcaaagcgcgctcccgcttcatcaaactcagacagctgtttttcaatagataagatatagttgtcatgctcccgctgattttgattgtgccggcggtatttaccgtttatgaatgattcaaatatattcataacatcccctcctcctatgatctatgccgggcagaggccggcgttcggcaaaaaacaaaaaaaccggaagctccggttttttttgaaaacggctatttcggttttttcttttggccgcagccgcagccttttttcttaatttttttttcgtaaggctgatgcacagttgatttgtatggagagtgttgggaaggtttgcttgattgattcatggtgatccttcctttccttatgtcatatatgccagtttatgccgaaagtgacggtaagttgctggtggaaccgccttattcctgcagaagacgagaaaccgcagcttcaatgatcccggccgcgccggctatggctaacagcaaaatcagccattgcgcagcctcggggatcacaatctgcgccgcaattaaaaaggcggcgcaccatacgcccgtacaccaatagcagctgagaagttcaccgataaatgccctgatgccttttccttttatgacaatgtaggtttctgtcgtgccgtcgggtgcggtttctgttttttcctcgtgaaaaaggctccgaagcggcgccataatggtgtcaaatacgaaaagcctggccagccggaaaacggcaaacgataacagaataaatgaaagccaattgataaccacctgttcactccttttcaaaacttgacctctttatacatatgcgaaaaccctgatcttcatgaatcgcaccttgtccggtaaaaaaataggtgcggtttagttgtttttcttattccgctcggcgtttcatttgcattatatagagtatgaatgagaaaggagtgaaggttatgtcgtttgaagaaaaagtcgaaacactgcaaccgcaaatatacgaacaattatccaacgaattcgagcagacgatcgaagtgattgattgcgaaaatgtcacaatagatacaacacatataacggccgctctttctatacaagcctcagttactacggcgattatcctcgcgacacagctcgcgatcgcagatgaagacacagccgaccaaatcgcaaccgaactgctgatcctggatgattgccaaataaaaaagaggaccgtcattcaagtcctgaacagccgcaatattaaaatcacactgacagcagacgatatcatggcctttgtacaaattttgtttcaattattaaatatactttttgctgaactagacatcctttaacctttcttttcaaatatttaaatagaggtgagaacaaatggcagataacgaaaaattaaaaaaagaactcgaaaatctaccagaagtggatccgcttttaaaggtgcttgtcagcaatgtcttcaaaaaacacggcgtgacaaaggataaaatgcgggaaatccctgatgaagaaaaagaaatgctgatcgcattagtcaaagacatgcaggcgaaaacagaagcttttcttgaaagccagaaacagaaaaaagagcaggaaaaagcgcaagaacagcagacaaatccgcaaacccgcagagaacaattaatcgaacagctccggcaaagacgccaaaatcccggtcaataactaaaaaatagtgatttttatcaggatagatgcctgagtcaaaataaggggccggctcatttaataatagtaaaagaaaaggaggaatagatatggaaagcagaccatactcttgggttgcacttgatcctgaatgcgaacatccgcgagaagaaaaagaagaaaaagaaggaagaagatgcagtgtttgctgtaacggacatggatttggcgaagataatgccttccttgaccaagacctggctcaggcgaatatcaacaaacaagtttctgaagaagcgattattatcagagactcttgtgatattaacgtaacgtcaacagacgttcaagcagtcgcttcagtcatgacagcgattaatgcagcagtcgtaacggccactctcacttcaattgctgacggagtcatcgctgaattggtcgcacaagacttattgcagctaacagctaacaaacaaatcaaccgtcaaaaattgctcatcgaaaactcccgcggcgtaaacgtgacaacagtagatgccgatatcgcagtgttgatctcaacagcgacaaatttactgattgccgtcttagtcatcacccttgtcctctaaaaagaaaaagcagagctaaaaatgctctgctttttcttattttctccgcatatgatgaatatatagacgttcacccacaccaagtgaggctcgcgtacatatgttgttaaagacaaaagtcaaataccctaaaagaaggagctgaaatccatgagctgcggaaaacaccatggccgagatgaaagttgtgtatgcgatgcagtcgagaagattttagcagaacaagaggctgttgaagaacaatgcccgactggatgctataccaatctgttaagcccgacggttaccggtaaagataccatcccgtttctcttgtttgataaaaaaggcggtttgttctccacattcgggaacgtcggaggatttgcggatgacagccagtgcttcgagtctattttcttccgggcagaaagagtttgtgattgctgcgcaacgctttcagtattgcgccccgtagatgtgcacggcgacaccctcagcgtctgccatccttgtgacccggatttcttcggtttagaaaaaacagatttttgcattgaagttgatctgagctgcttcagcgccattcaatgcctttcaccggagcttgttgaccggcctgagccgcacaaagagaaaaagcatcacggatagtcattgattcgcatctttcctaaagaagaatccccttccaaccttctattacagatgcaatcatcagcccgcccggacttccgggcggctgactctccgatatcgtttaatccggtatataaaacgtgaagtcaggagggatattatgagcaagcatacaacatactgtgtgcgtgaagcggtagaaaatattgaagacctgcaaaatgcggtcgaggaagattgcccggccggatgctattccaaccttttatcgccgggtttttcattaggcgatacagtgccgtttgtacttttcacttctaaatcatcaccgtttaccgcattcggaaatgtcggcgagctggataacggtccgtgttttaacaccgtttttttcagagttgaaagggtctgtgacggctgtgccacattaagcctgcttattgcttttgacgagcataagcacattcttgattttacagataaagactctctctgcgatgtattccgtttagaaaaaacgaactattgcgttgaagtcgatctccatagcttctgcgccatcaattgcctgaacccgagactgatcaaccgcacacattcttaaatcaaaaagcataaaaataagctgccggattaaagaattcaggcagctttttgtatggttaaaatccaagcggatgcagcgaggtaatatcgtctattgcgagttctgccggcgctccgttgcttgtcgtccgcaggaagatcgcattattttttcttccgacgattacgcctctgtaggttttcccgttggcttctatcagacaaagggtccgcggcatattatgcggcagcttcgttaagaaatcaattttttcaagaatggacattctgctcatcggctttttcacgcgctttggcgggaccttttcctctggggcggcattgtgaaccgcttcaggctctttttcagcggcttcaggctcttttttagcggcttcaggcttggcagtgtcctgctccgcttgcgccggaacttcttgaacggcttcttctgagcggctgtgctgttcaggtacttgcttttctggttcgacagccactgctccttcaggctgagttttacattcttcctcccgctttccatgcatcggctcttcttccggcggctgcggcgctttcctttttttgattaatatgtcctgcattgatgattgcgtgtctgaataatccgcctgaacaatatacatgagcggttttttttccgcgtttctgttttgttttgacatcttcatccctccgattctgtcatgttttatttatatgacggaatgattaaaatcagaagaaagaaaaaagcaatccctgaaagggactgcttgttatttaacgtgcggtaatatggaatcctgaatccacgtgaagattttcgcccgtgatgcctcttgacaggtcactgaacaagaatgcagccgtgtcgcccacttcttcaggtgttgtcgtgcggcgcagcggcgcgcgctcttcaatttctttcaggatagagttgaaatcactgattccttttgcagacagcgtacggatcggccctgctgaaatgctgttgacgcggatgttttcttttcctaagtcagcggctaaatatctcacgctcgcatcaagagacgcttttgccacacccattacgttatagtttgaaacgacgcgctctccgccgaggtaagtgagtgtaacgatgcttccgccttcagtcataatcggacgcgccgcttttgcgaccgctgtcagagagtaagaactgatgttatgcgcaagcaggaatccttcgcggttcgtatttaaatattcgccgacaagctcttctttgtttgcgaacgcgatgcagtgcgcgatgccgtgaatcacgccgacctgctctttaatgcttgcaaagcaagtttcgatctcagcgtcatttgtcacatcacacggaaggatgatggaatcatttctttctaatgtagccgcaaggtcatgaactgatttttccaagcgctctcccgcgtaagtgaaaatgaggcgcgctccggcttcatgcagcgaacgggcgattccccatgcgatactgcgtttattggcaacgcccatcacaacgatgttgcggccttcaagtgagaaattcatatgtataaagcctcctgtaatcgtcttaaagacatagttttagtacctgatcttaatttttatcatatcataaccttgtccagattgaaagcatgggaaaaagaccgcggatgttgaagcggtctcttttttatctcgtctgcagactgttccttttaaaggcaaaatgattggtcgggccgtgtcccgctccgatgccgagtgtatgttccacggcttcccgcacaaaattgacagctgtctcaaacgcggtctgaatgtttttcccctttgccgtttctgccgtcagcgcggctgcgaacgtgcagcctgttccgtgggtgtgtttcgtgtcaatataagcgtggctgatttgggtaaaagacgaaccgtcaaataataaatcaacgattctcccctgttcaggctgatgtccgccttttatgatgacatgctttgccccaagcttgcaaaggcgttcggccgcttttttccggtcctcaaacgtgcggatttccatccccgtcaatacctcagcttccggaacattcggcgtcaccgcatagctgcgcggaattaacagctcttttaacgcggcctgagattcctcacgcagcagggaagcgcctcctttggcaatcatgacgggatcggtgatgagatgatcaagcccgtactgatccgttttttccgcaatttccgcaatcatttccgcgctccacagcattcctgtttttacagcatcaggccgcaaatcttccgccaccgcgtcaatctggctgcccagcgcctcccgggtgagcggataaatgccgtgaacgcccaacgtgttctgggcggttaccgctgtaagggctgacatcccgaaaacgccgagctcctgaaaggttttgagatccgcctgtataccggcgccgcctcctgaatctgatccggcaatcgtcaatgctttgcatatgctcatgatgtttttcgctcctttcacattatccgatccatttatgataaaaagatttcgctctgctgatatcacttgtgccgtgtattaatgctctgccgtcacgaaacagtaccatcttgaaattgtctgtgcaaaatgaaattaaatacgggttggctgaaacatcaagccctgcccgtctgagctgtcccgcaagattttgcagatcaaactgttcggaaatccccgttctgatctgcaccgtgttccgcccgcacagaaccgccgcttttgtctgattttcataggataaaaacggaaaatcgtttgtgccgcagcttgggcaatcagccgacttaagacgggcgacgtttatttctgaccgttcatttttccataaatcaaaggaacggagaacatgctcgatagatccgcccgttaacagcttcagcgcatctgctgcctgaaaaacggccgtctgcaatacagccgggctgatgattcccgccgtatcgcatgtcataccgcctaaaggcaatgtctcaagcagacagtgaaggcacggcgtgacaccgggaatgacggtaaaagagagcccgtagctgccgacacaggcgccgtacagaaagggaattcctttctgcacagccgcatcattcacaatcagcctcgtttcaaagttgtcggcggcatccacgatgagggaggcatcacgaatcaatccgggtgcgttttccgcagtgacatccatgacaaatccctcgacctctacatcgctatttatagaccgaagccgtttttcagccgccgcggctttcggcatttcctgtctgacatcgtcttcggtataaagctgctggcgctggagattactccactccacataatctctgtcagcgatcgttaccttcccgacccctgctctgacaagcatctccgcacttgccgtcccaagcgcacccgcgccgataatcacggcatgagacgaccggagcttctcttggccggtgggaccgatcggctgaaacagctcctgtctggaatatctgtccgtcataccggaagaccgtctcgcggactgcttgcagttccgtaatctttcaccggaattctcccggcttcataagaaagacggcccgcttctacggcaagcttcatcgccctggccattttgaccggatcatctgcgcctgacacagcggtatttaacagcacgccgtcagccccgagctccatcgcgtaggcggcgtcttttgaagatccgacgccggcatcgacaatgaccggcaccttcgcctgttcaatgataaaagaaagattcagcggatttaaaattccctgaccggaaccgatcggcgaagcgcccggcataatggcatgcaccccgagctcctcaagacgtcttgcgagcacgacatcatccgacgtatacggaagcacgataaatccctcttcgagcagctgttctgatgctttcagcgtttcaaccggatcaggcaaaagtgaccggctgcatccgatgacttctacttttatcatgtcacaaagccctgaagctttggcaagccttgcgattcggaccgcctcttcagccgttgcggcgccggccgtattcggcagaagcgtgtatttagacaaatcaagctgttcgagaaagttaggctgagactcttcaaagatgttcatccgccgcaccgcaaaggttaaaatatctgattccgagacggccaccgcctctttctgaatctcaaaactcggatattttcccgttcctaacagcaatcttgaccgaaactgttttccgcctattgttaacatcctcatccgcctcctacaaaatggacaatttctatgacatcgcggtcacacaaacttgtattttcataattctttttttcaatgatttctttatttctctccacaactacgattctttggtcaagctggtacgattcaagcaaatcctgaaccgtcccctcttttcgattccaatcaatttgttttccgttcagctgaaggatcatatatgaacagcctccttgcgatcgattcgaaacgcttcttcccattcctgtttaatctgtctttccatgatcatatcccgcaccatttcagccgttgccggcgccaacaggatgccgttccgaaaatggccggcggcgaagatgatgccgctgtcttcagggtgttgcccgataaacggcttgccgtctcttgttcccggcctgagccccgcccaaaaccggtctattttcatatgttcgatggcgggaagcatggttttcgcttttgcaatgacggcctcaattcctccgatgtcaggcgtatcgctccagtcgccctgtttcatcgtggcgccgatgacaagccggccgctttttctcgggacgacataacaatgatcatggtaaagggttttggtcagcggggtatcgtcattccacacggaaaggcattctcctttcacaggaaaaaaaggctgtcccaagccgagccggctgaaaaaccggccgctccatacaccgcttgcaactgcgactttgtcagcataaacatccccgccggacgttgtgatgcaatattctccgttcacccgttttacggaagtgacttgtgtgtgctcatatatgtcagcgccatagcgccgcgctccttttgcatacgctttgcaaacatagtacggttcgacatggacatcgtcttttataagacttgcgccgagaatgtcttttgaagcgtaaggctctttttcaagggcatcttccgctgaaagccaagtgacggaaggcagatcatccatcttccgtaaacgggcgatatcttcttcggtatacgccagtttaagcattccgccgttatggcgcctgatgtcaatgccgctagcttcctcaagctcttgccccgccgcttcatacagcctttgactgtgcatggcaaaattaaaaaacgcatcccggttttcacattccgcatgagcacccagcattcccgcggcagcgcttgtcgtttttcggccgacttctccggcttcaaacaagacaacgttctgctgcgtcttcgccagctcataagaaatggcacacccgataattccgccgccgatcaccgccgtatcatagtgctgcttcataatcggcctcccttaccgcacgtgcataccgttttgccgcctcctcgggattttcagctgagaaaatgcctgacatgacggcaattccgtccggcttcgcctgctttgtgtgtccgatcgtctgcagtgtcattccgccgattgcgataacggggatggaaagcgtgcgtttgatctctgaaagcaggctgatgcctcttgcttcaagtccttgtttacattcggtttcaaatatatggccgaacaccacataatccgcatcttccttttcagcttggatggcttcttccagcgaatgaaccgaacgtccgatatgaagatggggaaatctgcttcgcacctgctttacggaaaagctgcgggacggaagctgaacacggtgtatgttggcaaaaagcgcgatatccgccctgtcattgatgatcaatttgtccttatccgcaccgccctttttcaaaagggacaaaagctgcatgatctctcccgctgttttatcccgctcacggatatggataaagcttacttcgcgctgaatcgatagaatatcctcggccagctcggcaacgggtttgcgattatcagttaccgcgtgcagctccaaaggattccacctcttttccgtccttctcggaccagccttctttttgataagccattccccaaaattgatattcataatagcttgaaatcacaaaattctctttcattttcgcgcggatttcctctgtgctgttttcagcaatctcgtcaaaacggctgatctgttcttcgacctgctgtctgaaccagtctccgccgtatgtaccgatccatttttcataaatcggatgctccggtttgcactcttttaggtgttcgccgacttcataataaagccaataacaaggcagaagcgcagctaatatttctccaaaattgccgctcatcaccgacctgtacatatgagacgtataagaataggcggtcggtgccggtttaaatgctgcacgctcttcttccgtaattcctaaaagctccgtaaactcgcggtgcagcgccatttccgcttcatatgtcccttgagcgtggcccgccatcctgcccgtcgtaaacaagtcttcggcatatgcggcgccgaacgcctgaacttttgcaaaatgcgtcaaatagtaggaatcttgcagcacgtaatagctgaaacggtctatcggcaggcttccgtcaccgattcccgttacaaacggatgaacaaaacttccgtcccaccattcggcagccgcctgtctgcattcttcagaaaatgtcatcatgtcttcccccctgataaaataaaaaaaccactttcccgcatcggaaaagtggtttggaatttaaatggataaaaggaaccccaaaaaaataccgctccacttccctacgcaggtctgaacctgttcaagttatgagggtctaaaagtctcacttttatctcagcccttatgaaggacacccctagtggtcatacgattaatgatttatttgttatgccttctatattatcacgaattgcaatttggtcaagcttcaaggatttttctcagttctgacacgtagttgcgcgagcctgtgacgatgagacggtctcctgttttcagccgtgtgtctccgtgcggaacgatgctgtccacacctctgaaaatccggacgaaaatcacatcgcccatcagcggaaattcccgcagaatgatgccgttatacgccgggttttccagattgatctgatataacgaagactcctcattcgtcaggaggctcatcacgcccggcgcctcaattaacgcgcgcagcagcgtttttgtagacagaaggatagaaaaaatactgatgccctcttctttcagttttgtttcatgctcaaccgagccgacgcttgcgatgatacgctcagtccctttctctttcgctagtaaggcgatttcagcgttcacatcttcatttcccgtcgccacgacaagaatatccgttttgaaaataccgtgcgactcaagcgtgccgggctcgtaatcagaaatcgtgtcaaccgaaaaaacggattccgcaagcgtttccccggcattttcctgatacacatggacgacccgtacttcatattcctcctcaggcaattccagcgtaaccgggagcgtcatttggttggcgccgataaatgtaatgcgctttttttcctgcggcgcgctttgccgtttgaataatttcttaaagccgatcggcgtgatgatgctggcaataaccgcaactaaagtcagcgcgccggacatattggcgctgataatgtggagcctttctccgatcgtagccgccgcgataacaagcgacagcgtggacgtcagcaaaaagcccgaagcaaacacggttcttttgtcgtaccatttctttaaataaaacaccgggaacattttgctgataaacagcgcaagcagaagcagcggaatcatcgttaatgttttcggatcttggaaaagcgtccaaatatccaatttcaccccgaccatgacgaaaaagatcggaattaaaaacccgtagccgaaggaatccagctgttccaccatttctttattcggagacagaagcgataccagaacgcctgccaaaaacgcgccgagaatattttccgccccgagagattccgataaagcgacaagcacgataatcagtgtgaaaatggctctcgtgccgatctgcacagtgcctttagacatcgactgcacaaatgaacggtgtttaaagatcctgccgaagaaatacagcacgacccccgcggcaaagagaatcaacagaagccacatatttccgctgtcttctccgtaaagagaagagaagaaagcgagcagaatcattgtagccaagtctgcgataacggcgacaagcaggatgatctggccgatattggagttcatgatccgttcttcctttaaagtcgggaccaccacaccgagtgatattgttgaaataataagcgtcattaaaaatgcgttttgaataaaaccggctaatacaaaggcataggacagcagcaatgataaaataaagatgccgaaaaagataatcagcgcggcagaaaacgtgttgggcgcttccttgccgttcggaaggaattgttttttcttccctttctcaaatgaagaaaaatcaatttccaagccgcttaaaaacattaaaaagataaagccgagaacagacagcgtctccagccacgtgtctccctgaacgacaagattcaggccgctttttccgataataagccccatgatgatctccgcgacgacgacggggatgctgagcttaaaccgatgtaaaaggagcggcgtcaaaaaagcgacgatcagaacgacgactaaagatgcgactgatgtgtgttccatttgtaaatacctccttaaaacaagggttataaaagcccgctttaagcggacgaaaccttactttttttaaaaacataacgcatattctaacaaggcttaacgcgaaaaaaaagtgataaggctttatttcttcaattctttttttaatttgtaccaaaacagcgtaattaggtataggaattagccccataataaataaaaaaccgttaataaggaggctgacacgaatggcttatgacatcatcagcgatatacacggatgttatgacgaaatgatcgccttaatgcaaaagctcggatatgaagtgaaagacggaacgcccgtccattctgaaggcaggacgcttgtctttgcaggggatttaacggacagaggcccaaaatccgtagaagtgatgcgttttgtggcaaaagcatatgaaaaaggagccgtccgttatgtcccgggaaatcattgcaacaaactgtatcgttacttaaaaggaaaccctgtaaaagtgatgcacggactggaaacgacggcagccgaactgaaagagctgtctcccgccgacagaacggaagtctccggacaatttatccgattatatgagtcagcgccgctttatgacattttacataatggcgatctcgttgtcgcccacgccggcataaaagctgacgatatcggtaaatactcgcgtaaggtaaaagaatttgttctgtacggcgatattacgggtgaaacgcatcccgacggcagacccgtcagaagagactgggctgccgactatgaaggcaaggcgtgggttgtgtacggccataccccggtaaaacgcccccggatcgtcaaccgtacggtcaacattgatacaggctgtgtcttcggcaatcagctgacaggctttcgttttcccgagcatgaaaccgtctctgtggaaagctctatgccgtatgatgcttcacgatttcgcgaggatcacggcaggcaggcatgaaataaagcccgaaaccggcaaacggttcgggctttacatgtgttcaattaatgttttcatatcgtcaggcaccggagcgtgaaaaacgagcgtttctccggtcatggggtgtacgaatgaaagccgctcactgtgaagagcctgccgggcaattccctcattttttccgccgtacaatgtatcaccgactaacggatggccgaggtagctcatgtgcacccggatttgatgcgtccgccccgtttccagccgcagggctgcaagcgtaaacgcatgtcccgctttttccgtttgaaaatgcgtcaccgctcgttgtccatccggcgttaccatccgctcaataatactgtcgtgttttcttccgatgggcgcgtccaccgttccttccttctgcagcatgatcccgtgtacgacagcgagatatcgcctgctgacaagcccctttttctgtgctgccgacaaaagagaatgggaaagccgatgtttggcgatgagcatcgcccccgatgtgtccctgtcaaggcgggtgacaagatgaaccgttgattgcacgccgctttttcggtagtggctgatcactccgttagcgatgctttttgacgggtgttctcttgatggaattgaggagacatacggctgtttattgaccacaagcacatggtcatcttcataaagaatatcaagcggaaccggctcaggcaaaagcgtttcactcacatgctccttcggaaattcaatcttaagcacgtctccctccgctaacacggtgcggacggttacatgctctccgttcacaagcaggtctcccccgccgaatttaatgtcagcgagaagccgctttgaaatgccgagctgcgccgtatattctttaaccgtcatgccggcatcccgggcagtcatgttcttttggataaaaaagttgtccaatccgtttcctctttctattcgccttttccgataaaggaatcctgcacccttttccaaaacggaaaagggcggaatcttgcaaatctgactttttcatttgccacacggcatagaatggacttgacatccttatgcagcaaggttaaatgatcaattgtgacttgaaagtcgacgtcgtttctcggtttgatgacacagttatgatgatcgggaagcaaaagcggcgagccgacagtcctgaacactctgttgttgatagatgccatttcggcaagctgaatcgccctgatggaagggtggatgattgcaccgcctaacgccttattataagccgtgcttccggaaggcgtggacagacataaaccgtctcccctgaacgtttcaaacagctggcctttaatttccacgtcagcgacgagactgccttctatgcttttgatcgtacattcgttcaaagccagataccgctcctcacgctcttcatcatgataagtgacaatcacctcaagaaggggatactccacggtatgatacggcgttttggcaatggccagaacgagcttttctatctcctgcggaacccaatcggcataaaaacccaaatgccccgtgtgaactccgacaaaagccgttttatcaagacggtcgctgtacctgtgaaatgcgtaaagaagcgttccgtcaccgccgacggaaataacgatttccggctctttttcatccaaggtcatatcaaaatcgagtaaatacgcctgtattttgcttttcagtgtatctgaaacctcgtctccttttgaagaaacggcaaatttcatgccattcccctcctttccttcctactggcggtctcccgcttttttctttcgcgagaacgcggcttgggcttcctggatttctccgcggatttctgacatttcttcatcgagccgggatgcggcttctgaggcccgctgcagcctcagctttactttttcgggaatgttcccgctgtatttgtaattcagtgaatgctcaatggttgcccaaaagttcatggcaagcgtccgaatctgtatctccacaagaacgtgcttttcaccggacgttgtttgtaaaggatataaaacgacaaggtggtaagaccgatatccgctttccttatgctctgctatgtaatcccgcttatcgacaacggtaaaatcttttctggcaaacagcatatttttgacgatctggatatcatcgacaaattggcacataatacgcagccccgcgatatcctgcatcgtttcaatctgatgaagcggtatgctttttcgtctcgctttttcaagtatgctcgccaccggcttcacgcggcctgtcacaaactcaatcggtgagtggtcatcttcatactcataaagggttctgacgcctttcagcttcacctttaattcttcaacagcctggcggtatggcgctagaaattgctcccattgtttgtcatccatcgtacatcccccaattccgaacctgttctaaagaaatacgtttttcactttttcttccatatctccgtagtttgcattatctttaatattttcaagaagataatcgagttcttcatgcagccctgaaagttcaaccgttttcgcgccggcctcaaggaccgccggttttccttggtctaaggcttctttcagatccggccagacatgttcttttataatgacatattcaaaagagtcagctgattcaagtatgtatacaaaagcaaagtgatcggaatcaacaagcatttgacctgaggctttgcgttccgctccgcttaagtcttctccgcacttcaagcggagcgcgtcttctgttaatgatgcattctggatttcaattctcttttgcataatgttctccttttttaacaaagtacagcatttattttatcatatcaaggtcgatattgataaacgtaacctctaaagagataatgggaattatacaatttttcgtcctgaaaggaagactgtcatgacccaagaaatagaaattgaattcaaaaacctgctgacaaaatcagaatttctgaagctgagtgaagcactctgcatgaaagaatatgattttaaacagcaggtcaatcattatttcgacacgaaagatttttccctgaaacaaaaaaaatcagcactccgcatccgagaaaaagacggctcgttcgttctgactttaaaagaacctgccgcggtcggtctgctggaaacgcaccaacagcttgcggcggcaccggatcttgacgtcttcaagattccggatggccccgtcaaacggcagctggacggtctcggaatccgttcagaacacatttgctgcttcggaacgctgtcgaccgcacgcgcggaaaaagaatcagaaaaaggcttaatcattttagatcacagccgatatttagagaaagaagactttgaattggaattcgaggctgctgactgggatgaaggaaaacaggcgtttgaacaattgctcaagcaattcggcatcccagagcggatcacgaaaaataaaatccagcgtttttatgaacagaaacaaaaaaaggtggaatgacacagtgaatataacgaattgggcggcccttctccagctgcagtcaatggcgctgcaatcaatctctcatacaagcacggattcaggcggacaatcttcagaaagcccgcttgccaatttcagcgcgctgctcagccagtatacggacacagccgtccggcagcagccggaatcagggattttaaacggtgtgcggaccgctcacgcttcatattcaccgagaattccggtttcatccggttccgcggcagcttcacagaccgtttccccgagcataaagtctccgaatgcggcttctgacatcagcaccggaaacttttcaatagacagcgccattcagaaagcagccgaaaaatacggagtggacgaaaaactgatccgcgcggttattaaacaggaatcaggctttaatccgaaagcggtcagcggtgcgggggcaatggggctgatgcagctcatgccttccacggcagaatcactcggggtgtcaaacccgcttgatcccgtccagaacgctgagggcggcacaaagtacttaaagcagatgctcacgaaatacgacggaaatgtatctctcgcgttagccgcctacaacgcaggccccggcaacgtagatcggtacggaggcatcccgccgtttaaggaaacacagcaatatgtcaaaaacataacccggcagtattacgcgtaaaccagagaggcttccttcgccctctggtttttttgcggagtgaaatcttacacatgaatgaaggcgatgtgatatgatatgaaatacaagcgcctgacagaaaggcactttgtttgtagaaataaaatgttattgctaaaatatacagtaactgaagatagtaaaactgaaagataaattcgcaatgggaattatgattcctattagccatataaaggagtagtcaacatgggacaatcgtttaacgcaccatatgaagcgattggagaggaacttctatcgcaacttgttgatactttttatgagcgtgtctcgtctcatcccttgctgaagccgatatttccaagtgatttgactgaaacggccagaaaacaaaagcaatttttaacccagtatttgggcggacctcctctttatactgaagagcacggacatcccatgctcagggcaaggcatctcccctttccgattacggatgagagggctgatgcgtggctaagctgtatgagcaaagcgatggatcaggtcgggctggagggcgatattcgtgaatttctgtacgggcgtctggaactgacggccaggcatatggtaaaccagtcagaagcggaggatcgatcatattgacgaattatcagcatgagcaatacttcgcccattgccacggacatccaaaaaaaccgctcgaaatttacatgtttgtcgaccctttatgtcctgaatgctggtcgctggagcccgccataaaaaaattaaaaatcaaatacggacgttttttcaccctgcggatcattgtttccgcgagcattacatcgctgaataagcaaaagcggaaaaaacaccttcttgccgaagcttgggaaaaaattgcgaaccgttccgggatgccctgtgacggaagcctttggcttgagcaggatcagcctcttgcatcgccctaccttgccgcactcgctttaaaagcggccgaactgcagggaagaaaagcgggcattctgtttctccgcagcatgcaggaaagcctgtttgtctccaagcagaatattacggatgaagacgttcttttagaaattgctgaaaagacgaaattggatgttgaagaattcaagcgcgacctccattcgcaaagcgcggtaaaagcgcttcagtgcgatatgaaaatcgcggcggaaatggacgtcaccgtcaacccgacattgacgttctttaacagcctgcatgatgatgaagggctgaaggttcccggcaactattcttatgacgtatacgaagagatcttattcgaaatgctcggggatgaaccgaagccttctgaaacgccgcctttggaatgtttcattgaatatttccggtttgtcgcatcgaaagaaatcgcactcgtttatgatttgagtctagaagaagttgaaaaagaaatgaaaaaactggcattcgccaaaaaggtcgccagagtggaagcaaagcacggtctgttttggaaatctctggccggaacccaggaggatgtcacctgttgtgaccattaaaaaaagctgattccttacggagccggctttttttgtgcaaataaagaaaccgcgccgggataagcgcggtttcatatgtcttaacgacaacaaaggggatgggagaaatttttcacggtcaaacaaaggggtaatgtttgtttgtgatcaatttcacatccttatcatatcaaatcttgtcgagttttgacaagccataagattaatgttcatatttttgtcacaaaacataactgactgcttgttttcatagaatatatcaatcataaacaaggagggaaatcaatgctccgcaccgtattgatcatcggaatgattgtgtttttcttctttttaaacctgctggccatgatgcacatgctgccgatttacattacatctccactgctgtttctgtccatattgtttgccctgtaccggctgaatcaccgaaaaacgtttaaggggttttagaaaaagcctgcgcatttaatgcacaggcttttttgaattacgaagggttcactttcgaaagaagctcttccatttcgttcagtttctcttcaaacattttgcaggccgcctcgatcggttcaggcgatgtcatatcgactcccgcttttttcagtatgtcgatcggatattccgagcttcccgcttttaagaattcggtatagcgctccaccgcaggcttgccttcttttaagatctggctgctcagcgcttgggccgcactgtagcctgtcgcatattgatacacataataattgtaatagaaatgcggaattcttgaccattccagactgatttctttatcaatcaccatgttgtcaccgaaatactttttattcagatcataataaagttcgttcagcagttcaggcgttagcggctcgccttcctgcgctttcgtatgaatcagatgctcaaattcagcgaacatcgtctgtctgaacactgtgcctctgaatccttcaagcatgtggttgagcaggtacagacgctgtttttcatcctttaagctgttcagcatatattcaccgagcagcgcttcattagtcgttgaagcgacttcagcgacaaaaatgctgtagttaccgtacggatacggctgatattttctcgtatagtagctgtgcacggaatggccgaactcgtgaacgagcgtaaacagattattgacattatcatgccagttcatcaagatgtacggattcgtgccgtatgtaccggacgaataagcaccgctgcgttttcctttgttttcgtatacatcgacccagcggttttcaagtccttcttttaaaatagacgcgtattcctcgcccagcggagcaagtcctttgagcatataatctttcgcttcctcatatgttaccttcattcccgaatcttttacaagcggtgtgtacaggtcataaatatggacttcatcaaggccgagcacctttttccgcaggtcaatgtaacggtgtaataacggaagatgtttattgatcgttttgataaggttatcgtaaacctcttcaggaatgctgttattggataaagccgcttcccgtgctgatttatactttttcacacgggcgtaaaaattatctttttttacagtgccgctgagtgtagtcgccatcgtgtttttatactgtccgtatgttttatatacggcttcaaatgcgtttttgcggacttcacgattgctgctttccaggaaattaataaagttgccgtgtgtgatttgagtttccttgccgttttcatctttaatcgacggaaacgtaatatcggcgttatttaaaacactgaatgtattggaaggcgaagacagcgcttcagaggcttccgcaagcagggcctcttcttgttcgctcagcacgtgcggacgctgttttgtaatttcttcaattgcatgggagtaaagcttaagctcctctttttcaagaataaactggtgcagcttgtcctcctgaatcgccagaatttccggttcaatgtaagcagtcgcgctggcagcctgagaatacaggcttgcggctttgtcgttcagcccttggtagaaagaatttcccgtatcctggtctgagcgcatatgtgcgtatgcataaagtttcccaaggcggttcgtcacttcatcctgtgccgtaagcgccgcgtataaattatcagccgaatgagcaagcgtgcctttaaatgaagataaattcggaattaattctttaactgcttgaaattctttattccaggcctcatcactaggaaaaatatcctctagtctccatgtatgctctgcctttacttcacttctctcaggcagctgtgctgctttattttcctcagtcatggtgatccccctcgttttctttacttcaagccaattgaaaaaacgattgtttctccaaaaacttgtgttgtgattatcttccggcttttcactgccttttgtcaaatcatatgcggcatataagaccgagcataccaataatacagtgaaaaaacgaaaacaaaatgcttgtacgcccctcacattcgccaccaccttgacgttagggtgaacgaaatgaagcattctcattccccaaaaaagagcaggtcccgccggcgcagctcttctgccgtttgagggcgcttctgttgagatgagggcatatatacttcattctcaatttcccttaaaaaatcctgcaagcataagaaatcagcatattgttttaccgccattccgataaggctgtcttgtgaaccataccgcatccggatctccttatgcctgattttttgccgtaaatcatgaaccatgccggataatcggatcggcgcgccttttttagaaagttccgcaagccgcaagtataaatggccctgccacacaaaaacgggacttgcaaacacaaagcctgctgaaacgggaataaacacttcagaggggagaaatggaaatgcaacctgatgtctttcgtaaaaaagacgccggataagaccggcatcttcagataaaaaccgcccgcctttgttgcggaagccggtaacggcacgcccccacgaggaaagtctgacgctgcgccgcccttccggatgacaaatgtctttcagatttgctttgtgaagagggattgcggttaagccggcataagaatagccggtgtaaaacggagtgatggaatgcagcctgtaaaaggagcgggcgtcggggcagtaaaacattaaggaggaaaatgaattgacttcaaagaactgccagtgaaaagcagaaagccggaaaaattgcgcggtcatccgttttaaccgttttgccccaatgatccagaccggccggtacccggcgtttttcaggcctgccgtccggctctttaaagagtccgccgaaaggttcgcacattgaaattcaaaagccagcctttcttctccgctttctgccgtcaagtcaggccgctgtccagcggaagtcagatacggttccaggctgacactgcacccttgtgtcttcagccagagaaaaagctgtctttttccttccagatggtattcgctttcaggttcggattccccgggacacagcctgctttttttatgagcgaagtgcggcagtttttcgcgtcccagtttgatatcaagctcacttttgcaaacggggcagaaccagcgtttctttctcagctccgccgctttttcctttgaatagcttccggccagctgaatgagccgtccgccggcagtcactgcactgaacatgttgcatcttctcctttcctgaatcttgttgtattcagcaggaagaaggcataatcctgtttgcggatgagagccgttatacggttttcagccgttcatcctgtcattcagaacaaaaaaaaccgatttctgctgagagaaatcggttttttatgatgcaaagtgtttttttattgtatataacgcatgatcagcgatcactaatttgccgtattcttcaagacggtgaatgctgactgatgattcgtgcgcgtactccaacaggatgcttagctgattttcaacctcttcatcagtttgctcataaaaatctgcatataaataatatcggtcttcaaacgaatacagggtcgttttgattccgttaagattcaattttgatagcgagatgagatcctcaaaatcatcgaaccgcaaagtgaactgaagcttttgctccttatcttcccggctctcggcctgctcttctttctggaaatcatcaagtaaagcatcgagattttcatctgccggctcttgttttttatcttccgggatcggcagttcgagtttttgtccgtccttggaaagctgggcttttgttacgattatttccagtcctttgtccaatgcctgaacctgaatccaaagaggaccctcgacagcgaattcctcttcatcatgcacttcatccatgacttcccagaacagttcttcactgcgctcgcgattgtaccagatttcttctctgtcaaaaccgcgatcttcaatatcaccataagacatataaaattttacagtatgctcattaattctttctatttccattttgccaaccttcccttctttataagatgttgaagggacatctaagctcccgatgaatagtactttactacactttacccattccgtccacatcttaaccttatagaagacagcgcaaattctttatatttctattttatgataaaacagttataaaagaaataaaaaagcattttcacaccgaaaaacaggctttctcccggttcccatcataaatagcgcactgcttcatatattagctgtacaagcaatcgatctataagcgaggtgttaccatgccgcacgattacctgctgtcccttctgcttattatcgggattgaccttattctcggcggtgacaatgccgtcgtcatcgcgatggccagccggaatctggcccataaacaaagacagcaagcgatcatcttcggaacatttatcgcagtcgtcttgagaatcgttctgacgagcgctgcggtctatttattgaatgttccttttttacaatgcgcaggcggggtatttttattgtatctcggctatcagcttctgattgagaagaaagatgcgcagcatgtgaaaagcagttcttctctttggaaagccatccgcacaatcgttctggctgatatctttatgtcgcttgacaatgtcatcgcagtagccggcgcttctcacggtgagctgacactagtagtgatcggtctcttcatctcggtgccgattattatttggggcagcaagctcgttcatgccgccatggaaaaaatgcctttattgatgtatgccgggagcggtcttctcgcatttaccggcggtgaaatgattgccggagacagcaagctgtcatttttcatggcagaacacggcatgatacagatgatgctgccgattttgaccgttgtttttgttatcctcgccagtatgatttaccagcagactgaaaaataacaaaaagcccaaaccgcgatggttttgggctttttccatgcttatcgtaagcttatatcagttggcaagacgctgtgcttctcttaattggaaagaacgcacttttcttggcaggaatcgtctgatttcatcttcgttatagccgacttgcagacgtttttcatcaatgatgatcggacggcggagcagtcccggatgctcattgatcaaagtatataagtcttgaagcggcatagattcaacatttacgttcagtttctggaatactttagaacgggtagagataatttcatccgtaccgtcttcagtcatacgcagaatctgcttgatctcatcaattgataacggctcggagaaaatgtttctttctacaaacggaatctcgtgctcttcaagccaagctcttgcttttctgcatgacgtacagctaggtgatgtgtataatgtaaccattaatcttcactcctctaattagtaggatgaacatgtttgtattctcaaattgaaatgactttaaaaaaggaatctttataggtattatactataaaaaagtaagtgtgaacagtctcctgagaaaaaaatgtgtcaatccggcaaatttacggctggaggatttttccccattctcaattagctcagctgatcgaaaatgtttttttgttttttctcatcaatgactttgagaacttcatccgttttctcgtatgattctccgtaccatttttcatctttataagtgtgaatgttttcatatgtctgtttcatcgcttcaaatatttcttcttctgattccgtcttaggtgaccagtacagaatctccattttgttcacttcattcgtagccaatgaccggcgccgatacccgattgactgcgcgtgcttgaaatgctctctttgataaaaacgcaagcgtttctgtgtatccgtgtcatcctcgtcaacaggctccacctcaagcagaatcggcttgttcttctttttcagtctgccgatcagcttgcttccgaggccttgtcctctggatttctttgacacaaacaggtaatcaataaagatgaaagagtcaaattccgcatacatcagcacgtggtactgcccctcttctttatgataaacatcgctttgctcctttaacagagcttccatatgcgcttttgatttcatttcttcaatcggaaaatattcactcagcttttcgtaccagttcattcatttgctccttatgggttcgttgtcttcacacttttagatataccccatttccgattgtttaaacaatcttacatctattaagacgtgtgatcctttaacatggtttcaatttttttaaaatggtgtgtaatcgacgtttttggtataacggtttgccgcgtcccacaataaaaattcgtcaattccttcatcatgcagcgctttaacctggtcctccacctggcgtttcccgtacttttgataatttccgctgccgagatatgatgccgtgaagtcctgaagccacggacgcgatacaggcgggtgtttcagcttggacagctttttattttccaccttcgcgtattctttgacgacattgtagggctcaagatccggtttatcaatgccgaaatagcttgtccaatggctcggataaatcatggatgaaatgacatcgacctggtctgaaattttgctgaaattctggccgataccaggcgcttccggcagcgtggctgaatagccgaaaatatcaaccgacacatccgcgccgtacggcttgagttttttcttcgcataaccgacaaaatcggtgacggcgtgaacgcgtttttgcacattgctgtctgctgtttttccgtaatcgccgtgtccgtatgtcagttcgtcatcacgtttttcaaacccttcaggaaaacggacataatcaaactgaatttcttgaaaacccatctttacggcttgttttgcaatctttacattgtaatcccatacttctttcataaacggattgacgaacgattcgccgcggccgtttttccagacacttccgtttttttctttaaaggaccactcgggctttttattcgcgagttcgctgtctttaaatacgacaatacgcgcgatcggatagatctttttttcctccagctttttcatcatcttttttgggtctttgatgtacggcttggcgattttggcatactcagaatggccgtccggcttaaaggtgaggttcccgttgtcgtccttgacatcaatcaccattgtattgagctccgttttgtccacaaagtctgtcagctccccgaatttgcttcctcccgctgaatgtcctgtgacgtaaatgccccgcaccttatcaggatgtgaaaaatgcagccctgacggataagcgaaccgtgcatttgatttcggcaattctttttcagccagtgctacttttacaagcggctgctcctctttcacagcggcatgggccggataagcggctgcactgataaacagtcccgcacaaatggcgcacaaaatggttttcatactgatctccccctttttttccattatagaaaaacgggagcaggcttaataaacttgaatgtgcgcaaaaaaatcctccaagactcagtcttggaggatgatacgtttatagataggttttaaattcagcttctgtgcacatgacaaaatgtcccggtttcacttctctgaattccattttttctccttcttggagctgatgaactgccggatcgtatttctttcgcgtgcgatttctttcatagtccggatcaggaagcgggatagcggacagcaatgatttcgtatatgggtgaagcgggttttcgtaaagctcatccgccggcgcaagctccaccaattttccgaaatacatgacgccgatgcggtcgctgatgtatttgaccattgataaatcatgggcgataaacaggtaagtaagccctttttctttctgcaattctttcattaaattgacgacttgcgcctgaatggagacatcaagcgccgaaatcggttcgtccgcgatgataaactccggatcaaccgccagcgctctggcgattccgatacgctggcgctgtccgcctgaaaattcatgcgggtagcggttggcgtgctctttatttaaaccgaccgtttccagcagttcgtgaacccgctgcatccgctcttttttcgtttttgccaggcggtgaatatctattccctcggcaataatgtcggcgactgtcattctcggatttaaagatgcgtacggatcctggaaaatcatctgcattttccggttaaactccagcagcttcttgcgggattttttcccgtggacattttccccgttaaagagaacttccccgccggttgcctcatacagccggataatactgcggcccgtcgttgatttaccgcagcccgattctccgacaaggccgagcgtttcgcctttataaatatcaaatgacaaatcatctacggcttttaccgttcctttctgcgtgaaaaaatgctgttttaagtgtttgatttcgagaagtttctcagtcatttttttcaccttccttcattaaaacaggatgctgatacgtattcggaagctgacggattttagccttcaccgcttcaggcggctcgaccttaggcgcatcaggatgcagaagccacgatttcacaaaatgcgtatcagacactttatacatcggcggttcctgttcaaagtcaattttcatcgcatatgagctgcggagcgcaaatgcatcccctttcggaggattcgtcagatcaggcggcgtacccgggatggccgtcagtttttcctgatcggtgctgtccagactcggcattgaggcaagcagcccccacgtatacggatggcgcggatcataaaagatttcatccaccgtgcccgattcgacgacctgacccgcgtacatgacggcgacccggtcggcgacattggcgacaacgccgagatcatgcgtgataaaaatgatagacgtatcaattttcttttgcagatctttcatcagctcaaggatctgtgcctgaatcgtcacatcaagcgctgttgtcggttcatcggcaattaacagtttcggatttgccgcaagcgccatcgcgatgacgacacgctgtctcataccgcctgaaaattcatgggggaattggccgatccgtttttcgggcatcggaattccgacgagatcaagcagctctatggcgcgctttttcgccgcttcacttgagattttttcatgtttgaaaagcacttccgtaatttgcttgccgactctcatcgtcgggttcagagaggtcatcggatcttggaaaatcattccgatgtcctttcctctgatggcctgcatttctttttcggacatcggcacgatatcgcgtccgtcaaaaagaatctgtcctcttttaaagtagcccggcggcatcggaatcagcttcataatcgcttgggaggtcacactttttccggaacccgactcccccacgatcgccagcgtctctcctttattcaaatggaaattgacgccgcggattgcctgtacctctccgccgtatgttttaaatgaaatggctaagtcttttacttctagcaaacgtgtcactcatatcactccttatttgcgtaacttaggatccagcgcgtctcttaacccgtcgccgacaacgttaaagccgaacatcgccaggcagataaagccggcagggaagaacagacgccaagggtaataggttaatgcaggcaatccgtctgaggccatcgttccccagctcgcaagcggcgcaggtacgccgaggcccaaataacttaaaaacgcttctgtaaaaatcgccgtcggaaccgtcagtgtcatcgttacgagtatagagcccatcgcgttcgggacgatatgcttaaacaaaagccggccggttttggcaccgagtgtctgtgaagcaagcacatactcctgattctttaattgcagcacctgtccgcggacgatcctcgccatattgatccagcccgtgatcgtcatggcgacgataatggtgagcaatcctttcggcaggacaaccatcagcaaaataaccattaataatgaaggaacagcccacagaatgtcggcgatgcgcatcatcacttcatctgtgcgtccgccgcggaatccggaaatgctgccccagattacgccgatcaataaatcaagcacggcagctgcgacaccgataaagatggaaatccgcgcgcccacccatgtccggacgaatatatcccttccaaggtcatccgtgccgaaccaatgatctttcgacggcgctttatccgcatttaatagattggtagtggcataatcataccttgaaaagataggcgcaaaaatcgccatcagaataataagaacgatcagtacgaacccgaccatcgcaagcttattgctgcggaagcggagcatggcgtctttccagagggaaaggctttttttatttattttttcggcatcgccggcattagctgaagctggttcaaacatatttttaggaatgttctgcatggtctaggctcctttctttgctttggaaagcttgattctcggatcgattaatccgtacagcacgtctacaattaatacgcatagaagcaggagcacgctgaagaacacggtaactcccataatgaccgtataatcacggtttgtaatgctgtttacaaaatgcgcgcctaaaccgggaattccgaaaatggattcaatgatgaaacttcccgttaaaatggatgccgccatcggccccatatatgtcacgaccggcaaaagcgcgtttcgcagcgcatggcgcacggtgactgacggacgggacagtcctttagcttttgcagtccgtatgtaatcgctgtttaacacttcaatcatgcttgaacgggagagtctggcaatgaacgccatcggcatggaagcgagcgcaatggagggcagaaaggtgtatgcccaggattcccatcctgcgaccgggaacagttctaatttaattgagaaaatatattgcaaaatcgtcgccaatataaagctcggaactgagatcccaaagatcgttaaaatcgcaatggtataatcctgccatttattatggtacagggcagcaagcaccccgaaaagcacaccgaacgctaaagcgaggagaatagcttctgcaccgagagtgaatgagacggggaagcctgaattgattaaatcattaacactttggcctttatatttaaaagaaggcccgaagtcccacatcgccacagattttaagtagctgacatattgaacgaaaagaggcttgtccaaaccatagtgttcgtttaagtttgcctcaatttcaggcggcagctttctttcgccggaaaatggtccgcccggcgctgcctgcattaagaagaacgtggcggtcacaatcacaaacaatgtgatgatcatgtaaatgaatcgtttaccgatatatttcagcaaggtgaacacctccatgttttttacaattttatacgtaatcagtaagaaaggtatatggggacatcctccccatataccttgggtcttttgttttcagaaccggcttttattcaaaagaagcgtttctgaagtaaacttcgcctgttcctgtcaagatcacatttttgaggtttttatcctgcacccaaggatccgtatagaaataaactggcgcgaccggcattgcgtcgataaagatcttttctgcttttttcagctcttcgatacgtttatccggatccgtttcaagctgagattggttcagcagctttttaaactcaggatcttcccacccggtatcattgtttccgccttctttatcacggaacaattcaaggaagttgatcggatcgttgaaatcgccgagccagcccatacgtccgatttggtagttttggctgtgcagcttgtcgatgtaaacattccattcggagttatcaagttcaactttgacgcccaagttctttttccacatttcctgtacggcctgcgcgattttcgcatgcgcgtcatccgtattgtaggacagcttgatcgccggaaggtcagaggcactcttgacgcctaattccttcagtcctttatttaagaattctttagctgatttgacgtcattgtctttgaagtaaccttttgtgttatccttgaatcccttcattgacggcggcaccgcagccatggccgggatttgttcgccctgcgttacatttttcacgatggacgagcggtcgatcgcataagcaagggctttacggatgttaacattgttcagcggtttcgcttctgtgttgaatttgtaccaatacacgcctgcgatcggttcaacgtgaagagatccgtcttttttcaatgtcggcagagattcagtcggaagctggccgagcggcattcctgcccagtcaagctcaccggcctggaattttttcagttcggtgttgttattgttaatcatcaccatgttgattttcttcaatttcacagcgtctttatcccaatattgatcgttcttttcgagcgtgatggaaccgctgtgtttccaggccgtcattttgaacgggccgtttgacacataattttcgcccgcgtttgtgttccagtttttatgtttttcggcgattttcttgttgatcggcatatacgtatagaatgaagttaattgcgtgaaataaggtgtcgggttattcagttcaacctttaatgttttgtcatttacggcttttacgcctacatcatcaatcttgccttttcctgtattggcagcttcagcgcctttgatgtagtagagctgataagcgtattgtgattcgttgttcgggtcaagcacccatttccatgcatattcaaaatcctgcgccgtcacagggtcgccgttagaccatttcgcaccgtcacgaatcgtaaatgtataggtctttccgtctttgcttgtttcaattttagatgccattccttcttcagggtcacctttggagtttacgcgtgtcaatccttcaaaagtctgtcggattacgcctcctgaaacggaatcattcgctaaacccggatgcaatgagaacggctcggttttaatattgatattaagtgaagtctgtcctttggtgtcttttttgccgccgcctgatccgccgctgaatccgccgcacgcacttaatacaagcgagaagataagcatcaaacctacaatagaccaacgctttttcatgcactaaccccctaatcaaatttttcagcctttactactaaatactcagaaatatcagacaaaataacttaatatttttctaaactttaattgtgttccgtcttttctgattattttatgtaaagaagctgtaacaatagagtgaacaagttcattataatgaaatgaataatttattgcaatactattttctcaatttaaaatatttaaatttggtcagtttttctgtcaaaaaggtgatacacttctatagtttaaagcatgacctaactaaatttttttaatgtaatttccagttcatattgctttttacatataatattcgttatacgaaatgttgatatacgttatcatttaagctttttcagttctttttgaggatttccacccctaaagtaaactggaaataagcttgtattcctctgatgacatttggctataattgatttataatagatcaatcaaatacatttgttgtgattgcgatgatgaagagtagtacacattttcatccgtttgaagagagtctgcggtgctgggagcaggtaacgggcgatgtggaatggacttctgagcagctgaccgaacgttagtaggcccagccggagcagcctccgttaccaacgtctcgagcgattccattgtaatggaataatcagggtggcaccacggttcattcgtcccttttttctacgggaagaatgggctttttttattatgttttaagaaatgaggtaagaactatgaagaaaacgattttttcaggcattcagccgagcggttccgttaccctcggcaactacatcggcgcaatgaagcaatttgttgatttgcagcatgactacaacggctacttctgtattgtcgatcagcatgcgattacagttccgcaggatcggcttgagctgcggaagaacatccgcaatctcgcggctctttatctggccgtcggacttgatcccgagaaagcgaccctctttatccagtcggaagttcccgctcatgcccaggcggggtggatgctccaatgcgtcgcatatatcggcgagcttgagcggatgactcaatttaaggataagtcaaagggcaaagaagccgtcgtgtccggactgttaacctatccgccgctgatggccggcgatattttactgtacggaacggatcttgttccggtcggagaagaccaaaaacagcatcttgaactgacccgcaacctggcggaacgctttaataaaaaatacaatgacatcttcacgattcctgaggtgaaaattcctgaatcaggcgcgcgcatcatgtcactggctgatccgctcaaaaaaatgagcaaatcagatccgaaccaaaaggcattcatcacgctgcttgatgagccgaagcagctcgagaagaaaatcaagagtgccgtgactgattctgaaggcattgtaaagtatgataaagaaaacaaaccgggcgtttctaatcttttgacgatttattctattttaggaaacacatcaattgaagaattagaagctaaatatgaaggcaaagggtacggtgaattcaaaagcgatttagccgaagtcgttatcggcgcattgacaccgatccaagagcgctatcgtgaattaattgagagcgacgagcttgaccgcattctcgacgaaggggcggcgcgcgcaaacaaaacggccggcaaaatggtgaagaaaatggaaaacgccatgggtctcggacggaaaagaagataaaaaaaagaggcgggagaatccccgcctctttttttagttcacttttgattcctgttccatttcccaaagcttttcgaaaaacggctgccctttaatcaaattttcacagaacgcaagatgtttatccgaccagccttcaattgtttcattgtaaagcatgtcccagatctcttcaaaactcatccgtttgatctgctcatacatatgcggattccattccgtgtaccaatacacaatttccgcacggtttttcagccctttcagctggtcgagcgccataaacatcagctgcttgatctgccgctcttttctcgtcagacctctgacatgccccggcgccaatgacaaaatgtgatattcctttgaagactccaattgcgacggctcaaattgaaacgattccggttctacatcctttaccatttcataaacaagctgctcctgtctcggaatcaggcggctctttctgaccggaatggtatacccgatcgtatccacggcaatgatgccgatcccgtctgtcacgacaaaacagtactccagctttgtccgctcatgattttttcgcacgtatgacttctggtggacttggtcaagcagctctttcggaagctctgataagtcgttttctatgtaatgaaataatactgacggcactctgagcagcggcgtctgatccaaaagctcaaccgtgtcttccttccgccattcgtgaaaatggcatacattgtagccgttttcttccccttcaaaccaattgacccatacatcatgaagaaataacatattcgacccctcactttataaaaactgttgtccacagtataggcaagggatagataaattattccatttcaatatgagatttccgttttacggagctggatttccgactgcattgcaacaaaaaaatctcccgttcgtccgggagatcatttcacatttttcggatcaagcgcatcacgcagcccgtctccgacaaagttgaagcacaatacggtaagaaggatcaacaaacccgggaataacgggtaccaccaagcctgtatcataagcgtaaagttctgtgcatcctgaagcatattgccccagcttgcgatcggcggctgaatcccgaaaccgagataacttaatgtagattccgccaaaataaccgttcccacctttaatgtggctgagacgataatcggtccgagcgcattcggcagtatatgagaaaagatgatgtgatggttttttgtaccgatcgtctttgcagctaatacaaactctctggaacgaagcgataaaaactctcctcggacaaggcgtgccgttgttgtccagcctgtaagggagaaaattaaaattaatttatccattccgggctgaaaaatcgtaacaagtgtaattaacaaaaatatatcaggtatggataatacgatatcaacggttctcatgagaacggcatcgacaaaccctttaaaatatccggcaacggctccgacaactgtcccgattgtaatcgcgccgatcacagaagcgaatccgacaagcaaggagacgcgcgccccgtacagaaccctcgtaaagatgtctcttccgaatttatcagttcccattagatgttttaagctcggcggcttcaaacgattgatgagagattgactctccggagagtaaggagcgattaccgaagcgaataaagctgacaagataatgatggttaatataacggctccgattacagctagtttattttgaaagaacttttcgaaaaaaatcttcgtcattgtttccggtttggattgaatattttcctttaatttcacttcgctggggggtgtgccggtatttggctgtaacatttgacctctcacctctctttgttaatattcaatgcggggatcaaccagcgcatataagatgtccgcaattaaattccccactacaaccaaaacagctgaaatgaccgtcatggccatgataaccggataatcccgcgaaaaggctgaatcaataaacaatttgccgagacccggccaagtaaaaatctgttctaccactaccgctcccccgataaatgacggtatcatcaaaccaaaaatagtgatgacaggaagaagcccgtttctcaaaccgtgtttaaaaatcactttattatctcggaatcctttcgcacgcgccgttcgtatataatcctgttttaacacatcaagcatactggatcttgtgtatctcgttatccctgccatgtctgccgtggcgagcacaaaagcaggcagaatcaagtgatgcaatcggtcaaatatgttaaagtcagcattcaaagtgcttactccgccagtgggaaaccaccccagatttacagataaaaccatgattaaaatcaaaccgaaccaaaaattcggaatggcaagccctaaaaatgaagtaacagttatcccgtaatccaattttgaataaggacgtttcgctgacagaacaccaaatggaatagaaatcagaagagcgacaagggttgagaaaagcataagcacaatcgtattcggtaagcgggataagataagttcagaaaccggagtgcctttcttgacgatagaagtcccaaaatccccttgcagcatattccccagccatttcacatattgaacaggttccggatcattcaacccgtatttttcaatgaatttcgccctgtccgcttgactgattgtagggtccatcataagtgacatcgggtctcccggcgctgctttcatgatggcaaacgacaaaattgtaatgcctaagagaatcggcaaggacattaatgttcgccgtaaaatatatgtaaccatattcttgtcccctttttaaataggataagagaggaaaggaacctccttccctctccagggcttttgctatttttgatccagccaccatttttcaatattgtacaagtcatttttagggtggaatacatagccttgtaaattattcggcatcgctctgtggtaattgtaatagaataagaagctgtacggctgatcttcagcaattaatttgtatatctcttcatacttcttttggtattcttttctgtctgtaattgacttcgcttcttcaagcagcttatcgactttcgggtttttataccagatattattcagcccgtttttcgattggcttgaatggaagatagagaattgatccgggaacgttgcaagactccatccgagaagaagagcgtcataatcccaattaggggcacttgtctgttcgattaacgcactgaattcaacaattcgcggtttagcctcgattcccacttcttttaattgctgctgaacgacaacagctaaatcttcacgaattttattgccttgattcgttttaatttcaaatgagaatttttttccgtctttatcaaggtagccgtcaccgtcatggtcttcccatccggcttcttttagcagctgctttgcttttttcggattataatcaaatgtcggcactttagacttcggataattccatgacagcggactctcaggaacatccgctaccttaccgtctccgttcagcacttgatccaccattgcctgcctgtcaagagcgtaagtcaatgcctgacgcacttttttgtccttaaaaagctcttttttctcattccagccgatatagctgtagtttaagccgagatcagatttgaccttcacgtttccaaacgttttaaccgtatcaaaatctgtgcccggcacaacgaagaaatcaatatctcccgcttttaactgggccacggccgcgttagaatcaggaattgttttgactgtcactgtatcaaggtaaggtctgccgccaaagtaatcatcatttgcttccagtttgacatactcaccttttttccactcaacaaacttaaacggaccggagccgattggatttttacggttaaattcattctctcccagatctgcaaccggcaccttacccaatatatgttttggcaaaatgccgtaactgtcgagaacgacattatagaaataggcatcttttttcttcattttaaactgaatttcatattttccttttttcgttacggatttaagggactcaaaacccgagccacgctcaccgttgtaatccttgttaagagggatgctgtaggtgaaaacaacatcatcggccgtcagctcttttccatcatggaatttaacgccttttttcagttttacatcatacgttaatcccccgtcagcttctgttactttttcagccagcgacggcttgacgtttaatttctcatccgtttccaataatgtgctgtaaatcatgccttcaatatcagaacttgcaacatcggtagaataaagtggattaaaaagtgtgggttccccggttgacccgacaaccaaatctccgcctttttgcggttttcctgccggtttggattcggtgcttgtggattttgagccggagcaggctgacaggaagatggcgagcgccataaaaacacttagcatcatcagtgcgcttttacgtaatttcatatcaattccccctttgtgatatatatgcagcaaactggttatgtaatccggcataccccctctcgatgcttgtcatttcaggcatataaatggcaggcgacgtaatggccgggagcggcttcttcaaatgccgggatttgttccttgcagatcggtttggccatcgggcaccgcgtgtggaacacgcagcctttcggcgggtttgccgggcttggcagttctcctttcaggatgattcgttcccgcttgacggcgtctttttttctcgtgacgggcactgaagacaaaagcgcttgcgtataagggtgaagcggattgccgtacagctcgtgtttatcggtcagctccatcatttttcccagatacatgacgccgactctgtcgctgatatggcggacaacactcaaatcatgagaaataaacaaataggtcaggttgaattcatcctgcagttcttccatcagattgatgacttgggcctgaatggagacatcgagtgcggaaacgggttcatccgcaataatcagctcgggattcaacgtcagagcccgcgcaatcccgatccgctggcgctgccccccggaaaattcgtgcggatagcggtttgcaaagctcgggtgaaggccgactttcgccagcagctcctccactcgctcgttccgctcgctcatgctgtacatatggtgagtctggaacggctctttaataatggaacgcagcgttttcctcgggttaagggatgcgaagggatcttggaataccatctggatgtttttgcggacgctttttctcagcttttcttcagataagccggagatatcttgccccttaaagagaatccggccgtctgtcggcttgtataaacggatcatcgtccttcccgccgttgatttgccgcatcctgattcaccgacgatgccgagcgtctccccgcgcttcagtgaaaaagaaacgccgtcaacagcctttatatcaccgactttcctttgaaaaaaaccggagcggatcgggaaatatttttttacgtctttcagctctaaaatcgtttcttggcctgcagctgtcattttgattgggcaccctcttcctcatataaaaaacatcttacagaacggccgctttcatgcgttatcagctccggctgccctgttttgcatttgtccatcgcttttgaacacctcggggcgaatcggcagccttccggaagattatccggtgtcgggacactgcctttgatcgcttttaatgtatcaatctctccatctatcaccggtatggagtttaacagcccttcggtatacggatgaagagggtttaaaaataagtcctccacacccgcactctctacgacttgtccgcaatacataacgatcaccctgtcggcggcttcggaaaccacacctaaatcgtgagtgatcagcagaatagaagtatcgaattttttgcagaggtctttcatcagctccaatacttgggcttgtatcgtcacatcaagcgccgtcgtcggctcatcagcgatcagaagcttcggattgcagctgagcgcaatggcgatcatcaccctctgtctcatccctccggaaagacggtgcggatattctttcatcacttgttccgctctggagaatccgacgagttccagaagctcaacggcttttttagccgcttcttttttattcatttttttatggtattcaagcacttcggtaatttgttcgccgatggtcagcaccggattcagggaagtcatgggctcctgaaagatcatagagacgtcatttccgcggattttgcaatattcgttttcggtgaaggaggccaggtccctgccttccagcttaatcgagccgtccataatttttccgcccgagctttggacaagtcccataatagaaagcgaggtgatgcttttgcccgagccggattctcctacaagagcgacggtttcgcctttgttaatgtgaaaatcaaccccgtcgactgcagggatcggctgtttctttctgaaaaaataggtctttaaattattcacttctaatagtgtgctcatgatacgcccctttctcattccgctgaagcagagggaaacatacgtttcgctatcacaaaatatagaatagtcgaaaaattttatagttgtatattattacatcattattacaaaagcaagaattttttaggataaatgtaatatccttaaataatttccattcttttaatctattaaagcgttgcttccagaaaggtttttgaagggatggccaatgcttcttttactgttttttgatggtcggttaaatatttttttactatattgaatccgacggcatagccaagcattgaggggaagtatccttttccgtataacagctgggaaaacattctgctgtctctcgttaagcggaggttcggcttgactcttttttcaaacaaaaaatcaagctgctcaggcgtatagtaggacgtccattccgccgtaagacttgagccgaaccgctcatatacagcatattctgccagcccctccatcatgattgtatcaagaaatgtctcatctttttcgtcctttgtcacatgttctaaccggcagacgtgattatattcatgtgtcataagggcggatacagctgaattggaactatccgacgatagaaagaggaacattttgtcccgaaaggccagaccggattttgatccgaattcctgacggattttccggtttcgttcatcaacgggcaaaactacgatcggcacgtccggcccgttccacttctcctttaaataggcttcctctttttgtatatggctgtagcatcctttttctttcagccgtttactggtcctaacgccgtccttcagatggcggaacatgccgtggttttgcagcatcccgagtatcggcttccactctttcttatcggcccctgaaaaaagcggcaaaagatgcggggccaggtcatttacggatgccgccttttccatccattgatatgtctgcttgacgctcataccggttcgcctcctcttgttgttatcatatgcacgcacaaaaaaaccggccacctttttcaggcagccggtcaaaaactgtattattgatattttttaaagatcaaagtggcattatgtccgccgaagccgagcgagttgctgagaacgatgttgacatcctgctcgcgcgctttatccggtacataatctaaatcacactcttcatcaggtgtttcgatgttaatcgtcggcgggataatgccgtctttaattgccatgacggagaagattgcttcaattcctccggcagcgcctaacaaatgacccgtcattgattttgtcgaactgacggcaagcttgtacgcatgatcaccgaaaacggtcttaatggcttttgtctcgtatttatcattgtagtacgtgcttgtgccgtgagcgttgatgtaatcaatttcttcaggcttgatgcccgcatctttgattgcttcctgcatcgctctcgcaccgccttccccgtcttgggcaggcgcggtaatgtggtaggcgtcacccgttgagccgtagccgacaatttccccgtagattttcgcaccgcgggcaagggcatgctcaagctcttcaagcacgacgatccccgcgccttctcccatgacaaagccgtcacggtttttatcaaacgggcggcttgccgttttcggatcaggatttgtagaaagggctttgtttgcgctgaagcccgcaaatgacattcttgtcagcggcgcttccgttccgcccgtaatcatcgcatcggcatcgccgcgctgaatgactttaaacgcgtcaccgatagagttcgttcccgtcgcacatgccgtcaccgtacaggagttgactccttttgctccgagagcgattgagatttggcctgtcgccatatccggaatcatcatcggaacaaagaacgggctgacccttctcggcccttttgtcaggaagatttcgaattgggattcaagcgtttcaagaccgccgattccggacccgacccaaacgccgactctcggagcgatctcgtctgtgatgttcagaccggcatcttgaacggccattttcgcggctacgacagcgtattgcgtgaagcggtccatttttcgcgcttcttttttatccatgtgattttcaatattgaaatctttcaattcagcagctactttcgccggatactcgtccgattccacacgtgtgatcggtccgattccggatacgccgccgattgcatttttccagcttgtttcggcgtcgttgccaagcggagacaaggctccaagccctgtaacgactactctttttttactcatcttgtgtgcacctcacctttttttatcgtccccagcgtaatgctatggcgccccatgtcaatcctccgccgaaaccgaccatgacgatgacgtcgccgtctttaattttgcctgcttccagttcctctactaatgaaatcggaatggatgctgcggatgtgtttccatatttatggactgttttagacatcttttcaaccggaagctccaaacgttcccgtgccgcttccatgatgcggatgtttgcctgatgcggaatcaaaaagtctacgtcctctttggagaggccggctttttcaataacatttacactcgattcacccatttgccggacggcgaatttgaatacttctcttccatgcatgattgtatgccctttttcatctaagtacaagtgctgaccgcctgtaccgtctgctccgagctcaaatgaaagtatgcctctgtcgtcgctgaccggtccgatgaccgccgctccggctccgtctccgaacagcacagccgtattacggtcgtcccagtcggtaatgcttgagagcttttccacgccgaccacgaggacatgtttgtatgtttgcgattcaatgaattgtttggcggttacaataccgtacataaaacccgcacatgcggcgctgatatccatcgcgcacgcttttttggccccgagcttctcttgtatcatacaggaaacggtcgggaaagactggtcaggagtaaccgtcgccacaaggatcatatcaagctcctcagcggaaatgccggcctgatcaagcgctttttgcgcagcctcagcggccatgccggatgaatacatatcttcagcggcgattcttctttcttctatacctgttctcgtacgaatccactcgtccgatgtatctaccatttgttcaagatcatgatttgtcagcactttttccgggatgtaacggccgacgccaagaattccagctttcattggaaaagactccttttttataatgaatttaaaactaattagttatgatcaattattagtatcaggtactaattctaccctattttttttctgttggcaatatattcgtctaaactatcggacgctgctcctcatagaataaaaggaagacgaaaggaggcttcactatggatattttctccaaaatgatgttcggcgattccagagaccgggataaagaaccggaagaaaacccggagcagcctcaggctgaaaacgaagaagagatcgattacaaccacgtgttgaatcagctggggtccatcatgaactccctggatcaattaaagcccgtatttaaagactttgcgccgatggtgtccgccataaagaaaaaaatcatgtgaaaagccacttcatgaaaaagtggctctctttatttattcagctccccggcatcagatctgccaagctcatacgcttccgccatgaccgatgtaaacaggtccataaacggctgaatcatttccatagacagatctatgccggatttctcaagctccgcctttgcttccggcaagtatttcatcgcgatctgcataaattcaagagacttttcatgctgcatgtgtatccacctctattcatttgacggcagttcatttgtttgattatacgttttgacaaggtctgagattttgtcttgaaacgctttgtccaccagcgggctgaacgtccccatttcaacgactccttccctgaaatcaaagtcgtgatctccgctcttgagcgtacctttattatattgctcggcaattaatgtataggctttatctacgttttgcaccgtgcttgtcagcaccgtgtttttgccgagattcgattgctcggcgacatagccgatggcgtaaagcccgtcttttttgatttgctgaatgacaggaacattatacccgtctccggccggatatacaacatccgtgccctccgcttttaacttctcgtaaagatgcagcgcttcattgccgttatcccagtggtccgtaaattcagtattgacggtgatatcaggcttttcatatttcgcccctttgataaagccgtctacttcaggctgccacaaaaaggaggcgatgacaccgacctcattggtttttgacatatgggcggccgtcattcccccgaaaaaacccattgcttctcccataaggtgaacgcttgtgacattatcgcttttcgccgttccgtttgcgacgacgaattccatgtcgggataatccttgctgatcatattgaagatttcctcgtattcatttccgtgcccgtataaaagattgactccttttttatgaaaatcatctatcgcttttaaaatatcttcatcggatctgatattttctttataataaacgtcaacgttaaattcagattgtatcgctaataaacctttgtaaccttttgtgccccataccaagtcactgatggtatcggggaaaagcattccgaccttctcaatttttcctttaaacggagtttgtgtgcatccgctcaataaaaggaggacagaaaagatcatgacaagcctggtgatcaagccatgttcaaccccttttcaaactcataacatgtataattgatatacgtttattgtagcggtaatgcacataacatggaaggtatttcttaaaaaatgtcgaatattgatgaaaattgtcttttccattctttaattttttcttccgcttccgttttttgcgttttttcttttatttccagggtaataatctgattttcgtcttctgtgccgtcagcctcaagcttattcatcagcccccagaccgcgtcttctaaaaagatcctgctttctccatcttcttttgcttccgtccacggaccgtaaaggggaggaaggataatcgcttttgccgtatcccgctgaccgtttttttcccagtctccgtgatcctcactgtaaacaatccaatataaaggctcagcccttttttcaggcagacacccgctcccgtattgaacgcagatacgatcgtattccttttcaccgatttcctctattatttgaaaaagcccgtttctcgcgagccacattaaacgttcttctaaatacagctgcctcgttttgtcctccggttctgccaaaatgacatcaacgtgcacaccttcatccatcaaccgttcgcacaatgaaaggccgagaaattcatctgctccaatgatcagcgctgttttcatcacatctgccgcctttccggtttttcatacacacacaagccaaacagccctctgaaaagagatggctgttgtattctattcattacaggtctttttcatgactgcggaaaaaccggcagatggctctgtacatacgagcagggttctcaagcaggtgatacgtgatatcaatcttgcttccggtcttttcccgggcttctttatacgcgttcgcgtgcagggtgtacgggtacggcgctccggtcgttctttgccatatatgtaccggcacgcgggtgcggcagccggtaatggtctgatagctcagtgagcttgcctctttttcagaaacaccgaagctttgtgccgtttccctcagaaactgcttataaaaaaacttattttctttctctgattcaaaatgggcttgaaggtccagacaaggatctaacattgcggctgaacggatatgctccggtgaagactgcagcaattgatcggcgatgagggcgcccatgccttctgcgagcaagtgtattttcggattgagggtttcttgtttcagcacataatgaatcagctgtctggcgtaaagggcggctttttccgaaccccaatgccgtccgtataaattgctgttgaaaatggtgtaccctctgtcaagcagcgtatttaacagctggtttctcccttcatgttcgagccaaaagcttgagtcccggctgacaaagtgagttctgtcccccagaataaagatacagaagccgttcggccgatacggcagatggatgacgttcagctcagatccgaattggaaaaatctttccgttatccccatgcctgcccgcctccttttactcctaatctctctattggctatcatatgtaagaagaatgaaaacggatcggataaactcctatttgctgctatgttttggctattatcccaagcacaggaaccgaattttccgtcagacggcaagacaggcgggcacatgtcagtttcaggcgcgctttttgatgagaaaatgaccttccgcccgcgctttatgtatggtatgatacaacgtagaataaaatgaaggacgaggtggaaacgtgcggtttattatcggttttatttggacgttccttttaacacatatggcctgttatttggtcgcctccatgaacagcgcggcgtacaatttcaagcaatcatccgttattgccgtggttattgcggtgctagtctttgttcttgcggagatcatgcctgtcaaacaggatgcaaaccagcattaaataaaaaacctgctattcagcaggtttttttgtgttcacggttttcgttggtacgtccacaatctgttgtggtttgaagtttcagggaacatttctcccaccgtaagtttgattttttgcggatttttgaccatgcttcccgtttcgccgatttcaacgtacacaccgttattcggcgctttttgtcccgggcggaattgatgctgctgtcccacgtcatttcctcctttttcttttttatgtagtatgcgcttgtatgcggagaaatatcaaaaaccgctgaatgagattcagcggtttttttgttcatcctgtttgtatagaagagctttcaggagcgctttttgcgcgtgaagccggttttccgcctgctggaataccgcagagttcgtgccgtcgataatctcggacgtgacctcttcttcccgatgcgccggcaggcaatgcaaaaatgtatagtcgggtttggcgagactgacgagtgaggcgttgacttgatacggagcaaacacattcagccgctgctgcgtctcttcctcctgccccatgctcgtgaagacgtcggagtaaatcacgtctgcatcccgcaccgcttcctgcggattttcggtaagggtgattttcgctccggaaacagccgctgcttctttcgcggcattcaccgcctcttcctctgcttcatagcctttcggcgaagcaaccgcaatgtcacagcccatttttgcgcagccgatcataagtgaatgcgcgacattatttccgtcaccgatataggcgacttttactccttttaattttccttttatttcttgtattgttaacagatccgcgagtgcctgacacgggtgataccggtcggtcagcccgtttatgacgggaatatcagcatgctcggcaagctcttcgactttttcatgctcaaaggtgcggatcataatggcatcaacgaagccggacagcaccttggccgtatccgcgaccgtctccccccgcccaagctgcaggtcgctgcttgaaagaaatagtcccgttcccccgagctgggccattcccgcttcaaaagacacacgtgtgcgggttgaagatttttcaaaaatcatcgccaatgttttcccttggaaaatcggctgtatcggatgttgttttaataatgaagcttctgtcagaagcgcattgatgtctgacgggctgacatcttttaatgaaagaaaatctttgccgtacaaatgggttaatgtgtgttccgcttttattgtgtgcatgatgccacttccttttgataaagatctttgagcgatacaggctgaggtttgccggagccgcttgctaaaaatgcctttacggtttccggttcagtaaagaccgtcacaccgtgcgtcatggcttcgatccgttgtttacgcgcttcttcagagtgattgaaattaatatggaccgctttatcctttcgctctgcccatgccgggaacgcatctttgcatacggtaaatcccgcctcttgagcctgacgttccaattccgcatcacagccttccagatagatgctgccttttttctcccagacgtgcgcgtagatttttttcagtgcgctttctgcgtcaaacgcgacacacatgccttctccggtcgacttcatttccggcccgggctttacgtccacatcctgaatggcgtgagaagaaaaaaccgggaatttcactgccgttccgtgctgattttgaacctcgggcttgatgtctttaagggaagcgccggccagcaatctggcggcaagcgggatcatcggcacccccatcaccttagacacgacaggaaccgtgcggcttgcccggggattcacttcaagaacgagaatatcccctttgtcatcaatgacaaactgaatgttcataatgcctttaaaagccagttttaccgcgattttttcggcggcctcttttatattccgctgcatatcaggtgtgacagacggacccggaagaatcgcaaaactgtcgcccgaatggacgccggcccgttcaatgtgctctgtgtaagtcggcacgaatacttcatgtccgtcggaaatcagatcgatctccaattcttttcctgtaatgtactgatcgatcaaaatcgggtacggcatgcccgcttctttttccaggagctctgacatttgcgcttctgaatgaacgatgatcatgcccatccccccgatgacataagacggacggatcagcacggggtagccgattcggcttgctttttcagttgcttcttcttttgaataagccgtttcgcctttggcatgtttgaggtcaagatcatcaagcagctgataaaacagatcccgatcctccagcgcatcaagggtttcaaaggatgttccgagcagcggaatgcccgctttttccagcggttcagcggcattgatcgcggtctgtcccccaaactggacgatggcaaaatcaatgttttcatgttccgccacgtttaaaatatgttctgtcgtcagcggttcaaaataaagccggtcggcgatttcataatccgtgcttactgtttccggattgttattgatcataatcgtttcatatcccagcttttgcagggtcagaacgccgtggacggcgctgtaatcaaattccactccctgaccgatgcggatcgggcctgagccgatgatgagagcgcgttttttctcttttcggctgacatctccgtcgctttccccaaggtaggtggagtagaaataattcgtcttggcatcaaattcagcggcgcatgtatctacgattttaaacgacgggacgatgcctgatttctttctgagagcacggatgtcttcttccgtttttcccgtgagagatgcgatcatgacatccgtgaagccttttaccttcgcctgctttaaaagcgggacagacagatgatccccttcttccatcagcttgttttctaatgtgatgatatttcggaatacatggagaaaaaacgggtcaattttcgttttggcatggatatcttctatcgtttcaccgcggcttaacagttccatgacgacgaaaaatctccggtcatccggcgttaccgctaattcccacagctgattgatcgtacagccgccgagttcaggcaggcgggtgccgatcgttttcagctcaagggaggccgccgctttttgaatggccgcttccatatttctttcgatcgccatgacctctcccgtcgctttcatcttcgttccgagcgtgcggtcggcatgtttaaatttatcaaacggccagcgcgggaatttgacgatgacataatcaagcgccggttcaaagcttgcataagtagagcccgtcagcggatttttcagttcgtcgagcgtatagccgacggcaagtttcgccgccattttggcaatcgggtagccggtcgcttttgacgcgagggccgatgaacggctgacacgcgggttcacttcaatgacatagtactgtttgctgaacggatccagcgcaaattgaatgttgcagccgccgaccacatccagcgccgaaataatcgccaggcttgcggaacgcagcatctgatattcttcatccgttaacgtctgggacggtgcgacgacgatagagtctcctgtatgcacgccgacgggatcgatgttttccatattgcagacggtgatgcatgtatgattgctgtcgcgcatgacctcatattcgatttctttaaatccggcgatgcttttttcgacgaggcattggctgatcgggcttgctaacagcgcctgtttaataagcgtctgaaacgattctttcgttttcgcgattccgcctccctttccgcctaatgtgtacgccggtctcagaataaccggaaatccgatagactcagcgaagcggagggcgtcttcttcgttgtcgacgatttcgctttccggaacgggctggtcgagctctttcatcagggcgcggaactgctcccggtcttcgcctttttgaatggtttccaccgatgttcctaagagcttgacgtgatgcttcttcagcacgcctgcttcttcaagtttaacggctaaattcaatgccgtctggccgcccaaattggcaagcagaccgtcgggcttttctttttcaataatggcctcgatgctgtcggttgtgagcggttcaaaatatatttcatcggcaaacgcctcatccgtcataatcgttgccgggttgttattgactagaataacgcggtatccttcttctttcagagccatgcagccctgcgttcctgaataatcaaattcagccgcctggccgatgatgatggggccggagccgatgactaatatgctggaaatggttgtatctttaggcatgagcgatttctctccttgctggtatcactttctctagaaattcatcaaatatccactcgctctcagccggaccgggatgagcttcagggtggaactggacgcttaatacgggaaggcgcttatgaatgagcccttccactgatgtatcattgacatggtgaaatctgatggacagctcgttttcgtcaattgacgcttcatcgacgacatagctgtggttctggcttgtcataaacacccttttcgttttccggtcaatgacgggatggttggcacccctgtggccgaacggcagcttatacgtatttcctccgaaagccagggcaatcagctgatgcccgaggcaaatgccgagtgcagggaaatcactgagtaaagatgtaatccggttcatgtacggcgcaatcgctttcgggtcgcccgggccgtttgagagcacgattccgtcaggctgaatgtcataaacggcatccatctgctgatacggaatgaccgttactttacagccgcgctttacaagtgacgaggcgattgattttttataaccgaaatcaatcagcgcaatatgccggtctccgttccccattgaagtgatgtcttcagactgcgccagctccgccggattttgtgttccggatgctgcgggaatttctcctgctgttgacacagcagcgttcatcgtgccgccggagcggatggctttgacgacggcccgtgtgtccacttcggttaagagcgggatgttccatttatttaaatactctctcaagcttgagactgcttcatggtgagaaaaatgttcacacgcttcatagacggcaacagccttgacttgtggaattttactttcaaggtctttttcattaattccgtagtttccgatcagcggatacgtaaagacgatgatctgccccttatatgacgggtctgtaagcacttcctgatagcccgtcattccggtgaaaaaaacagcttcgccaacacagcaagcctctttttcaagttcaccgccgaatgatgttccgtcttccaatactaaatagcctttcatctaaagcccacctcttgatgaataattaattaaaaatatgaatttttatacctttatatcgaaaaaaattaccgtttcactgccgaatgcgcttcgatcgctgctttcagcatactgacggccgacagcatttcttcttcagaaaccgtaagcggcggaagcagcctgatgacattcggtccggccggaagcacgagaagcccgcgttcctgcagatctccgatgatgccggacacgggacctgcgcattcaatgccgattaataacccttttccgcggatttcttttacaaaaggccctgtcagttcacggttcagctgcgcttttaaaaaagagcctttgtctgccgccgcctggagaaagtccggctgaaacacaatgtccaaagttgctttcacagctgccatggcgagcttattaccgccgaaagtcgtaccatgcgtacccggcgtaaaggcgtcggcaagcttctttttgccgatcacggctccgacgggaaaaccgtttccaagccctttcgcagcagtgatgatgtccggagagatgccgaagtgctcatagccgaatgccttgcccgtccggccgattccggtttgaatctcgtctgcgataagcagcgcctgtttgtctttgcaaaatgtctgtaaggcttcgatgaattccggatcggcgggattgactcccccttctccctgcaccgtctcaagcatgacggcggcgatatcatcctcttttgaaagtgtgctgaatgccgacgggtcattaaacggaagatagtgaaagccttggagcatcggtccgaaaccggtcttgattttgtcttgtccggtggcggccatccccgcataggtccgtccgtgaaaggattgatgaaatgttacgatttttgtctttcccgttgctttacgggcaagcttaatggcgccttcattcgcttcggctccgctgttgcagaagaaaacgagatccccgcgctatgtccggcaagctttgccgcggctttttcctgaagatcattttcaaacagattggaaacgtgccatacgctgccaagctgttctttcaccgcttccgtcaccgcatcatgacaatggccgagattggaaacggcgatgccctgaataaaatcgagatacgtttttccgttttcatcctctgcgattgtccctttcgcttttttaatatcgataggccagcggctgtaggtttgaaataggctgctcatgacacgctctccttttctttaacgatttttgttccttggaagacttgattggtgaaaaacgctccttttccgtttacgatcatcacttcctcgacatcttcactcagtgccgataatgccgagtttaccttcggaatcatcccccctgaaattacgccgtcatcgatgagggcctgaatttcttgcggcgtcaaagtatccagcctgttctctccgtccataattccttcgacatccgtgacaaataaaagtttatcggcgtgtaaggctgaagcgacggccgatgccgcggcgtctgcgttgacgttcagcgtttcgaaatcacttgtcatggaaagcggagcgataacgggaatgatgccttctttcattaatgcgtggatgattgacggatcggttttttgtatttcgccgacttctccgtatttgtcttgattaaggtaagacgcttgaaggagaccgccgtcctttcctgatattcccgcggctttcagcccgtttttcgcgagttcggttacgaaaaatttattgatcgtccctgacaagaccatttccgctgtttccagcaccggtttggtcgttttccgctgtccatcgacaaattccgtttcaatctgcaatgttttcagcattcttgaaatgtccgggcctcctccatgcacgacggcaaggttccagcccgattgcataagctcttttacattttgaaaaaaatcggcggataactcgcggattacactgccgccgcacttaaaaacgatggttttcttcatgccgctcccctttgctatgtgcgatagctcgcattgattttgatataatcataggttaagtcacagccccatgcccggccgctgccggagccttcctgcaggcggactgcaatcgtaatttcatcacctgataagtactccttggcatcagtttccgaaaacggctgaggttcgttgtgtttaaacagacactgaccgccgaggaaaacttccacttgttcggccgttacgcttgccgcactgtgcccgatggcgccgatgatgcgcccccagttggcgtctgtgccgtaaacggcggtcttcacaaggcttgagccgacgatttttttggcgataatattcgcctcaaggttatttttcgcgccttcgactctggcttcaattaatttcgtcgctccttcaccgtctctggcaatatctttggcaaggtcttcgcatacaagctttaacccctttttaaatgccggccagtcagggtgctgctccgtcaggcaatcattccccgcgcagccgttcgccatcacaagcaccatgtcattcgtcgatgtttctccgtcaacggtgatttggttaaatgaaacatccgtaatctctctgagcgcatttttgagcgactgttcttccacggccgcgtccgttgtgacaaagccgagcattgtcgccatgttggggtggatcatgccggagcctttcgccgctccgccgatcgtgatgatgtttccgccgatcaccagttcataacacgtctgtttcgtcactgtatccgtcgtcaaaatggcttcttcaaatgctccggacactgacggcgcttgaccgagctgttcaatgcccgcctgaatttttttcatgtctaaaagctcgccgatcaccccggttgacgaaaccgcaacaagctccggctcaatgccgagctggctcgcgaagccgtcccgcatttcataggcgtcctttaatccttggtctcccgtacaggcgttggcaatcgcgctgttgacgataaccgcctgaagcacggcctctttttttaagctctcttgcgtcactttcaagggcgctgcctgaaaatggctttgcgtatataccgccgcactgactgcaggcgcttcgctgataatcgctccgagatctttttttgaatagcgcagaccgcagtgcacgccctttgcctcaaaccctttcggcgaagatacgccgccttttactttcgtgatttcctcactcagctgaatcatattttcgaatccctctttcgttctatggatagactggcgtcatcgtaagtcccgtttcttcctgccagccattcatgatatttaaattttgaaccgcctgccctgcggcgcctttcatcagattatctatgacagaaacgatggtggcacggtttgttctttcatccacggtgacactgatatcacaaaaattgctgccgtatacctctttcgtcgccggaaattcaccttccggcctgattctgacaaaatatgaatctttgtagaattcggaatacaattctcttacctgtgcagcagacataccagggggagcctccgtatatatcgtcgccataatgccccttgtcatcggcgccaaatgtgcggaaaacgtgatcggacctgtgccgggctgccaagccgctaattgctgttcaatttccggagtatgctgatgctcattaaccttataaattttaaaattatcattcagctcagaataatgagtgcccatggatgcttttcggccggcaccggatacgcctgttttcgcatcaacaatcagaaaagaatcttgtaaaagcttattcttcgccagcggggcgagcccgagcagcacagccgtcggaaaacatcccggattggcaatcagcttagcagtctgaatctcttctttttgcagttcggctaaaccgtaaaccgcgctttgaatcgttcctttcggcgcggccttccgcttataccacttttcatacacggccgggttttgaatccgcagatcgccggatagatcaatgaccgggatgcccgcctccgccagcttgggcgaccactctccggaaacgccgggcggcgcggctataaacatgacatcaatttcgtttcgaatcgtttctatatgaagcggctgaagtgattgtgacgctatattcctcaaatgcggatatgaagcggcatattcttttccttcgtcgctcgatgaatataatatacaatcttctgcataagggtgatggttaagaatcctgacaagttcggcgcctccataaccagtcgcgcctataatacctattttcaacgggttcaccttcttggtttttgtgaaattatttaacattataacatgaataaaaattaattcaattgtatatttaatattttttcattcattttccatcggttttcgctgacaaaaaccccctctcgatcgagggggtttcataagaaaaacaggctgatcggatcagcctgtttttttcagcatcatcagcccgcttataaaaaacagcacggagctggcgtaaaaaataatataaaccgtgaagaaatcagcgagaaacccgccgagaataatggcggcagctgaaaatacggccgtccagaaatgatagctgccgacttttttcccccgctccccgccgtcagtgtaatcggcgatcatgattttctcgccgtgtttttgcatggcgccgaacaggcccaaaagcacctgcaccacataaacctggtgcacgccggtaatgtgcgggagcgtcagaagaagcaccgccatcccccacgaattcgccatcaggaaccagcggggatccagtcttgccgacagccggccgagcagcggatgaatcaatgcgccgctcaggccgaacaagccgtatgatagaccgaattgagtgtagctggaaccgatgtttttaataaataaaatataaaacggaaagatcaggctgccggcaaaaaagacactgctctgagacaggatcagccattttaaatggttgtgtttcatgatttgtacctctgataaaaataattcataaacaagtcatcgggatcatatttgtgttttttctgaaagaacatatcgcttttcggatatgcctcgcgcatctgctctttcgtttgatacagcatatacggcagataatagctgccgcggtggcgcaacgccgtatccgtcatttttctgacaatccgcgctgcactcgcctggctgtcttttgaaaacccttcattgattaaaagaacgagtgaaaacatgtcttcctttgcgtatgacagatcggctttttcatttttttgcacgtagcggatcgtaatatttacgagattgagatcttcatgtgacagcgtcttgcgtaaatcatgaatgtacggtgcaaattcgccgacgggcacgaagtattcttgaagcacgtcggtgttgtccgtgttttcatattccaaaaatttcgattctgaccgcatgacattgttcctggagactttcacgccgttttgactgagaaaataagactgctgggttgaccagaaccaatttcttccccagtcataccggcgggagaggccgagcgcgaatttcgtcagcgccggatgctcatcttctttcagttcattgtgccgctttaattctttctggttgtctgagagtgtgtaatcagtcacatacatatcgtgcaaaaagcctttatcccctgttgcgatccgcgcgagatgcatgcgcacggcggggttgcgctgaacatgctgcgtaaaatattgactgtatgtatcagcgttcatgcgtttcgttttcatttcataaagctcatcatccgtcagctcaatatccgcgtcaaggatgacgccgaacaggccgtagccgccgatgacggctgaaaacaggtcatctttcggagtaacggtgatgactttgccgtccgcctttaaaagatgaaacgatttgaccgtatcaatcagcgaaccgtaccggatatcccggccgtgggcgttggcgctcagtgagcccccgatcgtaaaaatgttttgcgattgcatgacttttaccgcgagcccgtacggattgacatagcgctgaatatcattccacgtcgctcccgcctgcactctgatgatttttttctttcggtcgagaccgagtattttgttgtagcccgtcatgtcgagaacgatgccgtcttcataatacgtctggccgcccattgagtgctgggcgcctgcgattgagatcttcaaatgctttctctttgcttccttaatcgtttcgaccaatgtttctttctcttttcctttgaccgtctgcttaattttcacgggcatgagacggcttacatccgtcattgtccctgcctgccgctccggctctttgtgaaaggcggaaacagcgaacagcgccgtataaacaagaatgctaaggataatgagaagtaattttttcttcatgggttcctccctcgcatgcagccggtctattatatcatgcctccgtccgtttttttcctttttaacccgataccgcaaaaaaccccgaatggcgggaaacttgttttttttagtgacttgcccttctttccgcacgccggtctgcagcgacaaagcagacgcgtccggcagaatcatgtttagtacagttcaaaacggtcatccggaaaacaccaggcataaaaaatacacagaaatccctaaaaatgattttttagtcagtatataatcgatatatatgcagatgtattaccaaagggattgtttaaaacaaagatgttaaatgaggtggggaaaatgaacataaaagggatcaatcatcttcttttttctgtttcagatttggaaaaatctatagaattttatgagaaagtatttcatgcacaacttctggttaaagggcaaaaaacagcatattttgatctgaacgggctttggcttgcacttaacttagaggcggatataccaagaaatgaaatacataaatcctatacgcatacggcctttacaattgacccaaaagattttgatgcaatacttcaaaggttaaaaaatctaaatgtaaatatattaaatgggcgtcctagggataagcaagatcaaaagtcaatttattttactgatcccgatggacataaatttgaattccgcacaggtacactccaagacagactgtcctattacaaaaaagataaacctcatatgaaattttatatataaaggtttgtttgcaatccaaaacaagccctcactgtcgcttatatgcagacaaaagaaaagcacctccaaactttaggatgtacctaaaatccggggtgcattttcttattactgaatccctaatgcgatttttgcgtagcgtgacattttgtctcttgtccacggcggattccagacgatgtggacctccgtctcttttacatccggaatgtcggcgagcgcttttttcacctcgtcgacgatgatcggagcgagcgggcaccccattgatgtcagtgtcatcgtaacgtgcgtcaggccgtcgtcatccatatcaacgtcgtatacaaggccgagattgacgatatcgacgccgagctcagggtcaacaacctgctccaaggcgcccatgatgttttcttttaatgcttcttccacgttccatcactcctttttcctcagtataacgcaaaagcggcttttgttaacacctttgtgctttataaatgcttatcgaaccaggcgacggtttctaaaacggcgtatctcgggactttatgatcagcccgttcgtctttcagaaactgaagatggtcgggccggctgctgtaatgaggtttaatcgtttcataaaagccgcgggtcggtgcatacggaacgactttgtcttgaacgccgtgccagaacagcagcgggcggctgcggagtttttccggttccagactgagatcgaacggtttgagccgcgcaaacagttcatcgacctgttcttttgtgacgtcaatgtcgatgtccttcttttgaatgtggtcaatctgctgctgaaaaaatgccgtatagttcggacttcccatcagactgacgccggctttgacccaatcatacgcagccatcgcgccgaatgtcgtaattccgcccattgacgtccccgcaagaccgatccgcccgtcttcaatcagaccgcgcccttcaaaatcctttttcagcacgtcaagctcctcgatttcatttaagacaatgtcccaaaaatggacggcgagctcttctgctgacagctgttcagcgcgttcaccgtggtaaagagcttccggcagcacggctctgaaacccttttcagcaagcaggtaagcgaaatgaagattatgctccttcgcgcttgtaaaaccgtgaataaagaaaacaaggggagcgggacggtcccgattttcttcttttacaatatgtaaaaacggaatgcctgatacggtttgatgatcaataagaatcacgttgactccctccttaggataaccataatcataagtgtaacatgtagacaataaagatggtaaaaagctacactgtacataagagaaaaacagcaaattatatgacaaaaggagttatttatggagacaaaaccttacctcatcgccttagatctggatggaaccttattaaaagatgataaaaccatttcccctgaaacggcacggacgattcagacgctgaaagaagcgggccatcatgtctgcatctcaaccggccgccctttccgttccagttcgatgtattatgacgagcttgggctgacaacgccgattgtcaattttaacggagcgtttgtccaccacccgaaagacgagtcatggggacgataccacacgtctttatctgtcgatgtggtcagacagcttgccgaacttacagagacctaccaaatacataatgtgctcgctgagatcattgatgatgtgtacttccattatcatgatgagcatttaattgaggcgtttcatatgaatacggcgaatgtcacattcggcgatctgcgcgaaacggtccaagaggatgtgacgtccgtattgattcacgcgaaggaagaggacgtcgcggacatacgcgcgcatttatccgatgtgcacgccgaggtcattgaccacagaagatgggcggctccttggcatgtgattgaaattattaaacacgggatgaataaagcggtcggcctgaagaaaatcagcgactattaccaagtgccgagagaacggatcatcgcgttcggcgacgaagacaacgatcttgaaatgctccgatttgccgggtgcggcgtagcgatgggaaacggcacggatgaagtcaaacaggccgccgatcgcgtcacgggttcaaatgaagcggacggaatcgccgaatttttaaaatcctatttctccctgtgaggttttcccgctcataacacaaagccttccgcccatactaaaacagacgactcatctcgtctaaatatggaagggggacattgcaatgggtaaacgaaacaaatcaaaacggtttattcagcaaggcaaggactctgtcagtcttcatgacgcaagatttccatatcggtctacattagaggaagcacagcatgatgcagcaaaagattcggctgaaaggcaggttgacttttaatgagaaacgaactgttttctcaagccaagtcatttgtccagcaggccgtcatgattgctaacggtttcgaggacggcgaccaggaaaaagctgtctcacgcgccaaaaatgccgtgtcttccgcgtacgccaattcgacggatgcagaacgtcagcagctgcaccaatttcaggatcagctggagaaattgcaataaaaaaaggcgccccgtttagatgagggcgccgcttttttatattacttcaaatgtttttaccgttttcagtctttttccgatctgatcggacttccctaaaaacgtcaccgtcaccgtgtatgttcccggaccgggcacgttcttccacacatctgaaaagtcatacgtttcattcggcattaaggtcacggtctgaaacgcctgggtaaacattttgtcttttgaatagcggtacagttctttgtgatgttggtcatgtacggtcagttcgaatttctgccctgagctgaatgtgaaatcgatcgggctttcgcttttgttttttaaagacatttgaaattcgatctgctgatctgtctgcacaggatttacggctaattccgcttgctgttcattcatctctccggatacctcctcagcgggctccttctgcccggattgactgctgcatccgatcaataaaatgaccggtaataacaggccaaacagccacttcattctatccgctcctatcagtcttttctgaagaaaccaaagatccccgtcgtttgcacgatgtttgtgaaggctttcgggtcgacttctttcacgattttctcaaggtcatacaattcgtaccgcgtgatgacgatgatcatcatttctttctgttcgtttgtgtaagcgccttttgccggcaccgtcgtaatgcctcggaccattttcccgtaaatcgcttctttgatttcatcagctttttttgtaacgatcatggcggtcagtttcatgtggcgcgtgtgaatggcgtcaatcacccttgttgtgacatacagagcgacaagggtatataatgctttctcccatccttgcaataatcctgccgtcaaaatgataatcccgttcaaaatgaagaaatatgtgccgaccggtttatccttccatttggccagcaccatcgacacgatatcaagaccgcctgtcgaagcgccgaatttcagcgttaaaccgatgccgatagctgagatgactcctccgaatacggtattcagaagaatatcgtgtgacagtctcatttccgggagaatccccataaagacggacgtcagcgctacgcttaatatgctgtatacggtgaatgatctgccgactttcagccaccctaacacaccgatgggaatgtttaagaggaacatgagaactcctgtcgaaatataaaagggggcgtattgatcaacgacgcttgacagcagctgggcgacaccggtaaaaccgctggaatatacatttgccggtatcaggaataaattcagtcccgccgcatacagaaacgcgccgatgacgacgattgctaatttttttacttgttctagtaccatggcttgctcctccgctcattttcattattagcttttcccttaaaataaagttttgaacactattttgccaaatttatatgatatagttggcatcactctcaccaaccggaaagaagggaattatgatgacagttcaccttattgctgacagcgcctctgacctgccgaaatcttatattgaagaaaaccggatcgggttcattccgctgcacgtaacacttgacggaaacgaatatgaggacgcggtcaccattcaggcggatcatatctttcaagcgatgcgggaagggaaagttccgaaaacatcccaggcatcaccggatacgataaaaaaagtatttttacaatacgcggaactgggagaaccggcgatatacatcgccttttcctcaggtctttccggcacctatcagacggccgtaatgatcgccaatgaagtaaaagaggaatttcccgattttgatttacggattgtagattccaaatgcgcttcattgggctgcggcctcgcggtgatgcacgcgcaaacactctgtgttaacgggaatacaatacaagaaatcgaaacgtctgtaaagaacttttgcgcacggatgaaacatatatttacggtcgatgacgtcgcctatctcgcacggggcggcagaatttcaaaaacgtccgcttttgtcgggggcttttgaacatcaaaccgattctgcatgtggatgacggcaggctcgtgccgctcgaaaaattgcgcggacagaagaaactgtttaaacggattatagaaatgatgaaggaagaaggcggcgattgggcggatcaaaccgtgggaatcagctatgcagataatgaagagacggcgattgggatgaaggaaatgattgaagaagcgttccatccgaaagaaatcattcttcattcaatcggctctgcgatcggcgcccactccgggccgggcacgctcgcgatttttttcctgaagccataatttcaatgcgggcgggcatcctaacggacagaagggaggctttgccgcatgaaagatgatgacaaaaaaccgttggacaataacgccgtaaaccagaaaaagaaccggcttgccgaaaaaaaccggcaggcgggaaaaaaccagaattccaaaaaaccggaccatctgtaaaagcaaaacagccctcttgtcttaggagaaagagggctgttttttgcgcacggatgtctgttacaaagtaaaccggcggacctgatcgtttaaccgctctgtcaggctcaccagattattgacgctttccgccattttatgaaaagaagacagctgctcaagcgcggaggcagaaatctcttcgcttcctgcagccgtttcctgaacgacggcgctgatgctttcggcatgatgcagcacttgctcaccaagctgtttcgattcgatgatccgtccgtccaattgagtaagctccgccttaatatgggcggctttttgttcaatatgggcgaatgattctgacgttttctccatcagctcctgctgtctgtccgctaaagcgacgccggtcgtgacagctccggtaatagatgtgatgccgtcttcaatttgctttaccatatcgaaaatctgcgcggtcgctttggctgatccgtctgcgagcttccgtatctcctcggcaacgacggcaaatccttttccggcctcgcctgctctggccgcctcgattgcggcgtttaaggacagcagattggtctggcccgcaatgtcggaaacggtctgcgccatcatactgatgcctgccgcatgcttagcggctttgtccgcatcgtccgtcatcgtttttttgagcgccgccagtttatccgagctgcttttcatatagctttgtacatcttctttctgggcgtctgcgagcgtataggaatagccggtgatgctttcttttaacgtattaaggtcggcttttgcttcctggacgtttaacagcgcgtccacttcatcttcatttgaagcctgaatcttcatcatgtttacgatggtaaagccgatgacggcggcgaagcaaatcatcgtaacggctgcgttaacgagcagccttgtccgtaatgtcacttcagatcgcctcctttttcaatcagactgtttttcatatccgtgatctttttcgtcagcccgcctgcgtttttgacaactctgatcttggctaagtccatgccgttttccttcagtccgtaaacgatctcaccgcttttgatctccttgttgtcttttaaatctttcgccaattcatagatgacatggtcgacgtttttcactaaagaagagataacggcgtgctcggcggtgtaatattgatcgctgtcaacaccgatggcgtatacttttcgcgcctccgcttctttcagtgcgccgacacccgtgaagccggccgccgtaaacaggacatcggcttttcttcggatcatgttttgggcgatgcgcttcccgagcttatcatcatcaaacgtaccgctgatttccgacagcacgcggatgttcggtttgactgattccgcgcctttcaggtagcctttcttaaaccgtttaatgacgtcggcatctgaaccgccgataaatccgatcgtgccggttttgctcgtcatagccgcgagcgctccggctaagaagcctccttcatcctctttaaacgtgacggaggtgacattatccaggtctgatacagaatcaatcagcacaaaccgctgcttcggatattttttggcgaccttttctaaatccgcctgcatgctgtaaccgagccccacaacaagatcattgccttcccggacaagctgggtcagtcctttttcgtacgtaccggtgtcttttatttctctgtaatcaaatgtgatgccgagctcgtctcttgctttcatcaaaccttgaaagcctgaatcattaaatgattggtcgccgaggccgttgtctgtcagcatgatgccgattgttttcgttttttcagccgccgcccctcggatttgccggcacatcccgccgtgctgagcgcaagcagcagtacagccgcaaatatcgccatttttctcattgaaactctccttttgtttttttctatagttatatatcggttcggatgtcagaatattttatttcaataaaatatgtatgttcggcaggttgataaacaaatgagggcataggagcttttgagaaaataaaaaacaccggttttggttcaccgatgtttttgcagaaaatttattgtttttcgtatgtccagccgtctttctgatacactttgccgtttttcatcaggtgcccgagcgcccgcttaaaggcggctttgcttaaatgaaaccgttcgcggatatcgtcaggatcgcttttgtctccgtaaggcatcgcgccgtttcttgatctcagataggtcagaatctcctccgcgtcaaccgaaagcgcatcctgctttctcggcagcagggacatgttgacggagccgtcttccttcacctcgatgacacgccccgtcacgcggctgccgagtctcggctcttcttttctttctgaagggtgaataaacgcgcggatgccttcatcggtaatcagaaaagagcctgatgcgatcagtctgtacaccgtgcctgtcaggtctttattcatgacgtcttcctctgcatccgtaaataattcactgatgatatcctcaggcgccggcttggcaaacatgcgtccgcggcttgtcaccttcagcatgcaatacagtctgtcgcctttttgcggccagacggatttgtacggaggcaggtgctccgttgcgacgagcgcgtcttttgacagaccgacgtcgacgaatacgcccatatcctccacagcgtccgtcacttccacccatccgtagtcataaaagctgatgagcggctttttcatcgtcgccgcgagtctttcctgatgatcgacgtaaataaatacgtccacttcatctctgtcttcaatatcctctgtaatttcactgttatgtaaaagaaccgtatcctcgccgtcggttaaaaaataaccgaaatcggtttggtgatctatactaagcgtgagctgctgccctggtctcatgttatcgtccttcctgattcgcccgtatggggctgatgtttttctcattttttccaatatgcataaattcatgctttatgcagttggacatttctctttattctactataatcaactcataagtgaaatgttataggaggttttctcatggcaaaagaaagttcttttgatattgtatccaaagttgaatttcccgaagtgcagaatgcgattcagatgacgctgaaagaaatcggcacgcgctatgactttaaaggatctaaaagcgatgtaactttagaaaaggaagaacttgtcctgatttctgatgacgagtttaaactgaatcagctcaaagatgtgctgagcggcaagctgatcaaacgggacgtgccgacaaaaaacattgaatacggcaaaatcgaaaatgcctcagggggcacggtgcgccagcgcgcgaagcttgtacagggcattgataaagacagcgccaaaaaaatcaacgcggtgattaaaaactccggcttgaaggtaaagtcgcagattcaggacgaccaagtgcgcgtcaccggaaaaaataaagatgatctgcagcagattattgcagccgtccgcggggcagacctgccgattgacgttcaatttattaattttagataaattatgtgattcctattgattattgtctctattttcggtaaatttggagaaagggattttcacagttaagttttggaaacccatgacaattacatgaacgttcttatcaagagaagccgagggactggcccgacgacgcttcagcaaccggtgtaatggtttaacccaaaccatgaccaaggtgctaaatccagcaagctaaaaacagcttggaagataagaagagagacaaatgattacagagtcttcttcttaagaagactttttttatttctcttttttccttgctgaatgtgacgaaggaggcaaacaatgggactattacaagacttaaaagaacggattttaatcggagacggcgcgatgggcactctcctctattcctacggcattgacagatgttttgaggaactgaacgtatcaaagcccgaggaaatcaagcggatacataaggcttacgtggaagccggggcagacatcatccagacaaatacgtacggcgcgaattttattaagctctcaagatacggacttgaggatgaaacgaaaaaaatcaatcaggaggcggtcagaatcgcgcgcgcttcctcagacggcgcttatgtattgggaacgatgggcggcatccgcacatttaacaaaaacgcctacagcctggaggagattaaacgcagctttcgggagcagctttatttattgcttcacgaagagccggacggtctgctcctggaaacatactatgatttagaagaggcgcgcgaagtgctgaagatagcgagaaaagaaacggaacttccgattatgctgaatgtatccatgcacgaacagggcgtgctgcaggacggaacgccgcttcgggaagccctcaggtcaattgccgatctcggcgctgacataacgggaatcaattgccggctcggcccgtaccacatgattgaagcgctcaccgaagtgccgatattccgtgacacttatttatcggtctatccgaacagcagcctcccgtctttagaagaaggccggcttgtttatgatacggacgatgcctatttccgggagagcgccgtacagttccgcactcagggcgcgcgcattatcggcggctgctgcggtacgacgccaaaccatatcagagccatggctgaagcggtccgcggactttcccccgtcactgataaagaagtgaaaatcagacgggaagaagaagtcatctccgtccggaatgaacggaccgagccgggtttaaacgaaatcgccgctcaaaaacggtcaattatcgtagagcttgatccgccgaaaaaattgaattttgacaaatttctgcaagcggcggctgaattaaaagaaaccggcatagaagcgctgacgctcgccgacaattcattggcgacaccgcggatcagcaatgccgcctgcggttcattgctgaaagaacgccttgatatccgttctctcgttcacattacatgcagagaccgcaacatcatcggccttcagtcacatttaatggggctggatacgctcgggcttaccgacattttagccatcacgggcgatccttcaaaaatcggcgactttccgggggctacctccgtctatgatttaacgtcctttgacttgatcaggctgattaaacaattcaacgaaggcatttctttatcagggaaaccgctcggcaagaaaacgaacttttccgtagccggagcatttaatccgaatgtccgccatcttgataaagcggtaaaacggctggagaaaaaaatcgagtgcggagctgactacttcgtgtcccagcctgtctactcggagcagcagctcattgacattcatcatgaaacgaaacatctcaaaacaccggtgtatatcggaattatgccgttaacgagcagccgcaacgcagagtttattcatcatgaaatcccgggcattaagctgtcagacagcatccgggaaaaaatggcgctcgccggcgaagacaagcaaaagcagaaagccgaaggcctcgccatcgccaagtcgcttctcgacacggcgtgcgaactgtttaacggaatttatttaatcaccccgtttctccgttctgatttgacatcagaacttgcagcttatattaagcaaaaggatgaaaagcgggctgatgtatatttgcattgacgcggaagatgccgcctgatacgacaggcggctttttcatggtacgatacagaaaaagaatcaagcaaaggaggattttttcatggttgaagtaaaacccatcaccgcagaagacacatacgcgatcagacacagcgtgctgcgcccccatcagacgattgaggattgtaaatatgatcaggacagcgtcaaaggagcatttcatctcggaggtttttacgacgggacattgatcagcatcgcttctttctacccgcagaaccagcaggctttacaggcggcgcccgcctaccagctgcgcggcatggcaacgcttgaagaataccggacgcaaaaagcgggaagcacgttaatcgcctatgcggaacgaaaactggcagatatgggggcggcgcttgtctggtgcaacgccagatgtcacgtgaagggatattacgaaaagctcggctggaaaagcacgggcagcccctttgacatacccggcatcggcccgcatgtgatcatgtataaagaactcgcctgaaacaggcaaaagcccgtggcatctcttataagggctttgttttgttatctttcggcgtgccggatgacgttcaaacggaatgaagcttttataagcgccgctattgacgcgatcccgctttgatattaacctttgttcagtaaacaacacgcaattcggcaagggtgggcaggggcgaaaacgatatctgccaattgccgatttcagctattatgtttagaaaagggagtatgagatgaatacgatccaaaaaccgaaaatcccgaaagaattgccggtgctttctttcactgaagcgcttcaggatgaggagctcaaagaagtcatcattgaaaacggcatcgtaaacggcaaactggacggcctgcgcgccgaaaaagtcattttcagaaacaccgtttttacggatgtctctttcagacatatggaatgtacggatgtcctgtttgacaaatgcgatgtctcaaacgctgatttcagcggaagcatcatccatagaacggcgtttcagcattcaaaacttctcggcttgaatctggcggattccgccatgcgtcatgtacggtttgaagactgcctcgcaaattacagctccttcagctattccaatatgaagcatgtccgttttgactcgtgcggcctttcagaaagtgagtggaatgatgctgttcttgaatacacagatcttgacgtctgtgatttgaacggcgcaaacttcatcggcacgtctctttttaatatggatatcagcacgtgcacatttgatcatctgcacgtctcgcttgataagctgaaaggatgccgcatctctccgtctcatgccgttacattcgcagaagcgctcggcgccatcgtgacgtgattttttattaaacgaaaccgcggatacaggcggccggctccccggcatcctgaatcaatgctcggcattggtgatgtggggtgctgctttttattttgcggcgcttttgtttcgataaaaggaattcggccaggtcatgttgaatgtaccggaaggaagagggggaattggaatgtcagacattttaaagctgtatcactaccatagatgggccaatgagcaagttattcagcatctgaagaccctgcccgcggcaagcttacagcaggaactggatagtgtttttccgactttgaacgccgtgcttgtgcatatatgccgggctgattacacttggcttcacgtgctttacagagaaacttacgaacaaatcgtctcgcagtttgatcaatttgaaaagcttgacggagattttgaggcgattgaacatagaatgactgaactggacaaagaatacagcgaatttttaagagaatcggagaacatggaaggcccgatctccatttctcatccgcgcatgggaacgcttcggacgacatatgccgatgtgatccggcatattgtgaatcacggcacataccatcgcggcaatataagcgcgatgcttcaccaaatgggctataaaggcgtgccgactgactacatttttttctcatatgaattataaaaaagcaaaggcatgccgggcctttgcttttttacttcgaatctatcataatccggcatagccgggggcgcccggggtaagctttacaggccttccggttttaaaagattccgtcgcggcgatcccgatttttaagttaatcgcggcatcgatgtctgtcacaatcggcgtttccccttttttcacacattcggcaaagtgctcaagctccagacggtaagcgtctttaaagcgggcttgaaaatccggaataatttcgtagctgctgcctgactccgttaaaatggtgacatggcttttccgcagcgtgccgactaaaatgcttccctccgtcccgataatttccgcgcggatgtcatggccgtacggagaatttcggcttgcctccacatcgccggccgcgcccgaatcaaactcaagatatgttaatgcctgatcgacatcgccgcactcctccatgaacgggtgctttaaaatcctcccgtgcccgctgacagacgtaacctcggcattcatgagatatctcgcgatgtcgtaatcatgaatcgagcagtcaatgaaaagccctccgctatgtttgataaattccgcgggcggtgcgccttgatctcttgtaaatcctttataataaatgggtctgccgatttccccggcgtcgattcttcttttcgcgtcggcgtatgccggatcaaaccgcctcataaaaccgacctggcagatgacgtccgtttcttcgatttttttcatgacttttatcgattcctcaagactcagggtgagcggcttttcaacaaagatgtgcttgccgttttcagccgccttcatgatcatttccgcatgtgtgcttgtcggcgtgacaatgatgacggcgtcaatcgtgagatcttccagcagttcatacggattctccgtccatttggcgattcctaattctttcgcacacgcttccgccttccccttcatcgggtcacagacggccgcaagctcggctccccgcacttcgccggctaaatgcttcgcatgaaaataccctaatcgtcctaatcccagcaccgcacacctgacttgatctgtcatctatcaccgctccttttttcttgaggccgcatgccgtaatggcgcaagcggtttctcttattaaacagaaatcattattttgaaagcgctttatttacaactcaagctgtttgctttctttgcttgcaatccgcagtatttgcgcaagcgctttctcaaaagctgttttaattttacaatgcttttcgctcgtttgacaatgtttttcacagaaaaaaacgcgccttatcgctgagggcgcgtttttaccggtgccgtagaatgcctgatgacgagttccggagataaaatgattttgctttttgtttttttcttcccttgaatctcatcaatgagaagttcaacgacacgccgccccatttcgcggatcggctgagaaatcgtcgtgagcggcggtgccgtcatttcagcgagaatggtattgtcaaagccgatgacggacaagtcttccggcacccgaatgccccgggagcgcgccgcctgtatcgccgcacatgacaagacatcattaaaggcgaaaacggcggtcggaaggtctctgtcaaacagctcgcccgctgcctgttttccgctttccagcgaatattccgtcggtatgatcagcgattcatctagtgtcatccccgcttcccgcagcgctttttgaaaacctttgattctgtctctttcacccgtggtcgaaccgtttccgacgatacaggcgattctttcatggcctaaagatatgagatgctcagccgccgtatagccgccgagaaagtcatcgataatgacgacgtccatcggcgcgagcggtttatcctgcgtaatcatcgcaagcgggatgcccgatttcacaatatcatcaagcgccgtgacgctgtcatcatgatcaagtcccgtcgcgaatataatgccgtccgcctgcttctgccgcagcatcgaaaaatacttcgtttctttttcaggctgataatcggtgctgcagataatgatatgaaacccaagtacaccggcgctgtcttcaatgcttttcgccagttccccgaaaaacgggtttgaaatgtccggggtgatcaggccgatcatattcgtctttttgcccgtcaaagcggatgcgtgaacattcggatgatagtccatctcctccatgacacggagcaccatccggcgggttttgtcactgatcctccccgtattgttgatgacccgcgagacggtcgagatggagacgcccgctttttcggccacgtcgtaaattgtcattttcatgcttaccgatccctcttctgttctctggtattaggtcagtccgttttccggcttacgaatttgcggtattcaagcggcgaaatgccttcaatctgtttaaacagtttggaaaaataggttgggtcctccatgccgatggcgtccgcgatcgcccccattttgtcattggttgcggacaaaagacgtttcgcctccgtcattctgactttgttcgtatactggccgggcgtgacgccgagcacctgctgcatgcagcgggtcacgtagtcttggttgtaatgaagtgccgaagagagcgctttgatggttgttttctcctgatagtgctcctgcaggtaccgggcggcctcccatgcgactctttcctttgcggacgggatttggaacgcttctttctgaagatggagcagcagctcttcaaacagaatctgctttctgagcggcaggtcggagttctcggcgctttcatctgtcagcacactgaattgcccggccataaactgcgggcgtctcaccttccctttttgcggcagggacaagcggtagcgggacggctcttcaaagctccctttttttcgcctcagctccgaccagttgttcccggtggtttccgtcacctcataatccgctccttcaaaatgaagccacgaataggatgtcgtttcttcactgccttttgttccgtaatgttcaagcccgggagaaagcagaatatattctcccgcttcaacggaaaaggcgttttcgtcttctgtaatgtagaggacgccttctttcacatacagcagatcaaacaccgggaagacccgtctcacatgggtttcgccttttttgaacactccttctcccgcagcgataaagaccgggaacggagggactgtgaactcgagaaaggacatatttccggccctcctttttaagtcggatttttgcaagaagtttcgtttctctccctttttattataagaaaatggaggtacacttttaaacgttgattttttcaggaaaggggttaaaagaaatgaaacaagcgattttaaaacgggctgcattcaaacaatcctctgatcacaaactctcattatacgcgctgacttggccgatatttattgaggtttcattatatatgtttatgggaaacgccgacactcttatgcttagccaatactctgacaacagtgtggcggccgtgggtgtcagcaatcagattttaaatttaattatcgtgatgttcagctttatcgcaacgggtacgacaattgtgatttcacagtttttaggatctaaacagaaaaaagaggcgcaggaagtggcttatgtatcaataggagcgaactttgtcatcagtctcgccatcagcgccgccatattttttgcggccgttccgctgcttcatgtgatgggtctttccaatgaattgatgccggatgccaaagtctttttgcaggtggtcggcgggctgtccttcattcaggctttgattatgacgttcagcgccattttaaaaagctacggtcatacgaaggatacgatgttcgttacgatcgggatgaatattttaaatattggcggaaactttcttgtcattttcgggccgctcggccttccggtgttaggcgtcgccggtgttgcgatgtcaacgtcctttgcgcggatcatcgggctcatcgcgatgattgtgatcgtcaaaaaacgcatcggactcggtctgacatggcaaaagatttttcacgtccataaagagcacttgcggaaactcctgaaaatcgggattccgtctgccggcgaacagctgtcttataacatttcacaaatggttgtcacttattttatcgccattatgggcgctcaggcgcttacaacaaaggtttatacacaaaacatcaccatgtttatcctgctgttcggaacggcgatcagccagggcacacagattttgatcggcagatatatcggcgccaaacggtttgacgacgcttatgaccgctgcatgaaaagtctgtactgggcgcttggcattgccgctttgacatccgtgatcatgaccttgttttcaaagcagctgatcggaattttcacaagcagccctgacattattgcgacggcgagcatgctgatcgccatgacgatcattcttgagcccggccgttcatttaatgtcattatcatcaactcgctgcgggctgccggagatgcaaaattccccgtctacatggcgatgatttccatgtggggtatcggactgcctctcgcttatctgttcggcatccatttcggattggggcttatgggcatctggatttcatttatcgcggatgaatgggtcagaggcattcttatgtacagaagatggcggtcgcggatttggattcaaaaagggattgcataaacgccccgagcttcgttaagaagccgggcgtttttttatgcctgcgaaagccgttttctcatgtcaccgagctctgaccggtaatgtgccagcaaaccggtaacggcgggtcttgagtataacggaaacagctccagctcttcagacgcctcctcgaaatacgcctcggcctcgaatgcgatgtactcccatacattcataaaagctttgttgacggtatggctctccagctcttcttccgtatagccgaattgcatcatcacctggcgcgggagacgctttttcgaccactcatccgtatggaccctcagaagcacccgggtcagctgaatggctgctcctaatgaaacggctgcatggcggagtttctcttggttccggcgcgcgcaaaccggcagcagaagcaggccgagggctccgcctgtttggcccgcgtacatcagcaggtcatcaaactcttgatacgttactttttctctgtcagagatgtggccggcgataaactcacgcaacggctcttcttcaagtgcaaattgctgccgcacatcagtgagcgcctcccacaaaaagccgtcggcgcgtgccccgttcagaaagtcttgtgccgcctgttcaaatcccccaagttcctgcatatcaagccgatcagcttcgtgaaacaaagcaagcaccgcccatgcggcccgcctgttttttggcggcagggatgagaaagtccgtttatataaaggaaagtgcacctcggcaagatgggcgcatgtttcgtattcggtcatggtatcactcctctgttttttagtgtaccatatgtttcacaataaaaagaccgatatccttcagcggaaaccggtcgcggcactgttattcttctatatcgatacggtacgcctcaaaccatgtatggatctgggcaagatgggcgatcagctgcgggcctttcatcagctggccgaaccacggcacctgaaaagatgaaccttctgtctccagcagcatttccagcttctttctgtcaagcagggtgtgaagcacggaatctttctgttgtaaaatcgttttcagccattctgtgaccccctgcgtgtatttcgggtgatgcgttttcggataagggctttttttgcggtacaaaatatcttcaggaagcagtccttcaagcgctttccgcaaaatgcctttttcccggctgccatgcattttcatttcccaaggaatattccaaacgtattccacaagtctgtggtcggcgaacggcacccgtacttcaagacttgcgcccatgctcatgcggtctttgcggtcgagcagattggtcataaaccaaagcatatttaagtagaacagctgccgtctcgctttatctgttcccgtctcaccgtctaacagcggcgtttccgcaatggtttcttcatatctcgcattcacgtattctctaagattcagccgtttttgccacttttcatccaagagcgtgaccctctcctcagtcgacctcatccaaggaaatccgtcttcttctgccgcggtgtgaaaccacggatatccgccgaaaatttcgtccgcgcattctccggaaaggctcacgacaaaatcttttttaatttcccggcagaaccataatagcgatgaatcaacatcagccatgcccggcaggtctctgacgagaacggattcctccagatgttcaaccagctgatcctgcgtaatcacgcacttatgatgctgtgtgccgaatgcatttgtcattttatcgatccacgggccgtcatcattcggctgaaaggcgctcgctttaaaaaatttgctgttctcctcataatcaattgaataagtatgaaggggatctcttccttgtttctcaaaatgagcggcggctatcgcggttatcgcgctcgaatcaagcccccctgataaaaacgtgcaaaccggcacgtcagatacgagctggcgtgtcactgcatcctgaaataagtaccgaatgtgagcggcggtttcatcgaagctgtctgtatgcttttcgctctttacattccaataacgccatatggacaaaccgtcctttgagaaagtgaacgcatgggcgggacgcacctcgtgaattcctttaaacaccccgcagcccggagttctggacggcccgagtccgaatacttccgcaagtccgccgctgtctgtgcgggctttcacatcaggatgagcaagaatggctttcaattccgacccaaacagaaaggaagagccgtgttctttataaaaaaacggcttgacgccgagccggtctcttgccccgaagagccgctttcgcttttcatcccagatggcaaaagcgaaaataccgttcaagcggtccacgcactcctcccgccactcaatatagctgtgcagcagcacttctgtatcagaggtcctctcaaaacggtggcccctcgcctgaagctccttccgcaattcctccgtgttatacagctcgccattataaatgatggtgtacgtttcctcttgatgcgtgcaggccatcggctggcggccgccttcaatgtcaacgaccgaaagtcttttatgtccgaataaaacatggggctctccccagacgtttgaatcatcaggccctcgttttgaaagagtgtctatcatattgttcataatatgtttctcttggacgagctgcttttgaaaatcgacccaacccgcaattccacacatgtgatatcagctccaatcccgtttctgtcggtttcaaattcgtttctatcagcactttacccagtttatgcaaagaaacgcagatagttgatttgtcccactaagagttgtatgagacaagcccgatttggaaagaacggaagagaagaaacaaacaaaggagacgggcacggttatgaaacgaaaacagcttttctcagaaaaaaacaaatgggggcgcggcacactgatgatagaggacggcatctgcctcgtcgaaaacgatgaaggcgatatcctgcttgcagacagtctcggaaacgcagacgtattgatgaaacgcgacggcagatggcagccggcacggatttgcggcggttcggccgaaatcggcgcagacaccatccccctgctcggcggggaagaaatccgttatgaaaaggcggtcaaacggccgctgttaaccttgctcgattcgctggacgatgaaacgtttctgctgtttctcagccatctgcacgggttcggcctgtctgtatatgattgcgtattttcctataatcaggcgctgttttccggtgaaggcgtttcgttttatcacttctcggcggatgacgcacaatgcgccctgcagcatcaccgcggcagctcgggtaaacacgacagatttgaatggacggcatctgacgggcggcgctccattatgtattcagcggcaagacaagacggcaccgcgtaacaaacaggcggcaccttttaaataggtgccgcctgatgtattcagctttgtttttcacgctgattgacggccggcgtttgcttttacccttcacagccgtagcttttgcggcaacaagagtgattgacgcttttggcatcctggacatctctttcgcctcatcaacacggcatttctcattcagcggcccagttgcgcaactaaaaaaaacccggatgcatccgggtttttcaagcgattgattaaaatacgtgaaaaccgatcggcaagtgaaggcccagcagcaccgtcaggacgagcacgataataaaaccgatccacagtccgccggttgatttgccttttttcttgcggatgacgagcatttccatcagtccgatggtaatgatgccgagcagcatttttcctgcgtactctccgttccaattcgcaaaacggacaaaaagctcagctccggtcagaataataataatgtagaataagcgcagaatcatatgcgtaatttttgcgcccttcgcttttccggcaccgtacagcccgtagctgacaaacaccaggataagcgcaacgacccatgaagtaatatgccaatgtgtcattatgttcaattccccctatcagatcaatctgcctcatttatggtaccacaacaagccgctcggagcattatcaatcgtgcgaaagacacacaattatccgatttggttcgacagcgtgccgatcggttcaattgtaatgtcaatgcggtcccccggctttaaaaatttcggcggcttaaacccttttccgacaccggacggcgttcccgtcgctataatgtcaccggcttcaagcgtcatcccttttgacagcgtctcaattaattcagctatcggaaaaatcatgtcacccgttgatcctgattggcgcagttctccgttcacccgcgtttcaactttcaggctttgcggatcactgacggccgacttatgtacaatgaccgggcccatcggacatgtcgtatcgaggcttttgccgataaaaaactgtttatgttttttctgcagatcgcgcgctgtgatatcatttacaattgtatagccgaatatatgatcaagcgcatgttctttggagatgtgcgatccgctttttgatatgattaccgcaagctccccttcataatcaagctgctccgttacatccaagtggctgttcactgtttctccgtggcctgtaacggcagccggggctttcgtaaaaaccatgggatgctccggtatatccgcctcactccccatttcaacggcatgatcacgataatttttcccgatgcagatcacgttctttgaaggtctcggaataggcgcgcaaagctttacgtcagacagcgcatacataaatgaacccgactcgtcattcggttttttcgcccattccgcaagctgtccggcatgcgcgacgaacttatctcctttttgaatgcactcgatcagcgaacccggaatcgtctcaagttcaaacaattttttttcagccttttgcagatctaagattttgtcatcatcaataatcagaccgacaaattttcggctgttcagttcccctgttgcaaatttcatgttaatcccccatcatttttaaatggcattcctttatgtattcttcctccgggcgggaaatccctcttttaaacaggctgaaaataagtgtaaaagagtatcaaaaattgtcacttttttagtcatattgacgaaataaaaccttcttggccaaaatgggttatactattatcatcctatgttttccaaaataatcgagaattggagatcacacgatgaacaaaattgaagaaaaaagattaactttattcgagacagcgcaaaaattcggaatcaatgcgacggagaccatcaggtgcagccaggagctggacagccttttaaacgggtgccggggcgggctcatccaacaaacgaaagacagcgggccgaacccggccgcacagattcagcacggccgcgaaagaaaagaggctttctcataaacgtgatatgtatataaatctgtatcatttatgtataagacccggcatctgtaaagcgccggtgttttttacgtctaaagttttttccgctcacaaaaatgtgcatttgtcataagctattttaggcaggcagcccagataagctcctggagtgcagtcatgaaaatcttcacgaaaaggatgtgctcgtatgcccgcaattgtcggagcgtttaaaattaatgccgtcggtacgagcggagtcgttcatataggcgactgcatcaccatttctccaaaagcagaggttaagacatttgccggagcgggcagcttcaataccggagacaatctcacactgacgaattacaggaattcaacgaatgtgtacgataatgatgtaatcgatcagccgatggcaggaaacgcataaaggaggcgccgtatgaatttttacgtcaatcagtcgatccatatcaattacatgcgtgtagaatctgtcagcaattcctccatactgcaaatcggaagcgccggttcaattaaatctctttccaatctgtacaacacagggagttatgttgagccggcgccgcctgtcaccgcggggcagcaggctgtaacaacagggggaggtcccggcacctcatcatttgtaccgctccagccgccaagccggtagttttaatgaaggaaacgagacgcgaggtgaatgtcatgtatgatcaatccgtttcatcctacctgcagaatttaaattctttcgtccagcagcaggcgcagcagattcaggagctcgaacggcagctgaaagaattccaaaatgaaatttcaacgctgaagcagcagccttctacaagaatcgatcggctcgagtataaatttgatcagctgaaaattgaacggctggaaggaacgctgaatatcggattgaatccgactgatccgaatgccgtgcaaaacttcgaagtcggccagacatctccgcaggtcggaatgatgcagcaggaacaggcgggccagcaaatgcagcaaatccgtcaaaacgtcgatatgtacctgaatgaagaaatccccgcgcttttagagcagctcgaaactcagtatgagagcaggctggacgaaacgaacaaatatcatattattgaagatatcagaaagcagatggacagccggattcagtattatctgtcccatgtcccgaaagaagaaaatacggcgcccgcgcaatatgccgagcagattgccgaacatgtgaagcgtgatattgtcagggccgtcgagcactttattaaacacatacctggtgaaatgaaaggtgatgatccgtcatgatttttacagtgattaaccggaatattgaagtcggcgacatccggtctactggtgtatccagttcttccttattattaatcggcgacaccgattccgtctatctgtcttccatctttgacacgcctccggaatctcttattatcgggccttatgtgccgctggcgccggaataatgttaaagcgcatttcacgcctccggaacgccaaaatcaattcagtcgggattgcgagtgtctttcaagcaggcgatacgaatgaaatcaatatgcggatcaaagtattggccgatcagcgcagtcttgctgtatacagagatgatgaaggctcatttaacaaaaaagaataccagatctttcggcagccggccgtcatgccgttaccggaaacgggagtccaaagcgcattctgccatgaaaatccttcaattcgggtaaggaatgtgaaagttcaaggggtatcgtcagcgtccgtggttcaaatcggatcgacgtcggtcgttctgggagattcgcggctgaaacatattaggcagatcttcacgccaagctcacaatcacagcagccctgacatataatgacggtgagacttctataaagggtgtcgtttatgccagcaattaccggacctatagctatcaattccatatcgggcggagtcgtaaactttggtgattccttttacctttctccaaaaagctcttctaaatctgcgctcggttcgggagcaggcaataccggagatttcctgttattaaacaacgttgtcaatgcgacaaactatatagaccccgatgtcagcgatcaaaatgtggtcggaaacgcctaaaaagcagccgctctttcagaagagggctgcttttggttcagcgttattttcgttcatttgctttttttgtttttacaagcttttccggcggctgttttctgatccatttcacaaaccgcgcgagtttcgggtcacgccgcagctcttctattcccgcgagccttgccgcaagctcctgattcgtatagagcgcgtgaacctgtttatgacaagggatgcagagcattgcggtcggaaggaatgtcccgccttcttccttaggcgttaagtggtgctccgtcagccgcacataatggcggccgcataattcacatgtaccctcggcagaatcggccataattccttctcctttctacatgatctccaatgtgacccgggtgcctttcccgcccggttcggacggatgaacgattaattttttcggcagacgcgctctcagctcctgcacatggctgatcactccgacggataagttgtccgattgcagcttttcgagcgctgtgacaacggtgtctaagagcccttggtcaagagtcccgaatccttcatctaagaaaaagaattgcagcgggtattgcccccgcagctgaatctgggcggacaaggccagcgcaagcgacagcgatgtcagaaacgtctccccgccggaaaggcttgatacgggccgtttgacgcctccgttcgcgtcatcacgcatgacgaaaccgccttctgaatcgactaatatggcataccgctgccttgtcagcgctccgagacgggcagaggcgtcccgagccacgctttccagctgttcttccgctaaaaattcgacgaatgtattgcctttacatacagactggagcttatcaagcctgtcaatctgtgtctgccagtttttcagttcggcttcaatctctttaaagcgcttatgctgtttttgcataaccgcgaaggcttttgcctgtgctcctttttcctccatggcggcgcctgactcagcctctgcctgcttcagcagagaaacggatgctgtccattcttcctccgatatccggcgctcggctaatttatcagtaacacggctgatatttgccgatagctgttttgaggtgtccagaaactcatcaatttcttttttcatttcctctgcacgcccttgcggaagcagactttttttaacttggtccggttcggtaaacccggtgtcttttgacctcacgcgccagtcgttttgcgctttctcaagagaggcctcagcatccctgagtgacatgagactccctgattcccggccttttgcgtcattcagcgattgctgcgcctgcttcagcgcatcgaatagggactgttcttttgattttaacagctgtaattcctgccgcaccgcttcaagctttgcggaaattgatgtttcttcagctgctgttccgagctcttgttcatatccgtcaatcacctgctgcaggcgctcagacgcatagtgaagctcgagccgttcccgttcaagccgatgcttcatctcctgcaggcgttctttctcctcttcatgttccttgaggaatgcgatgcttgtttcaatgcgcttctcacattcttctgcctgcctgtccttctcatctatcgaagcctgccaggcgtcaatccggtttggcggaatatgaccgcagacttcgttgtactgattcaatcggctttctgacagcgattcaagctcttctaatgaatgtctgagacggtcggcttctttttcctcgtagcggattcgttcggcaagctgctcagcttgttttaccgtctgctgatgcgcgctgatcagtcttgcgaccttctcttttaccgacagcatatcctgtttcatttgtttccattccaagcggacggcgctgaacgcttcatcaagcgggcgtccgctgatggaagaagcggcttccagctccggaacccgggcgctttgcagaaacggacattcttcggtaaaacgccccgactgttcttctaatgcaaccttggctgtcagcacttcctgagaaagagccgccgcctcagaaagcagtgcttccacctgctgcaaatgttcctgcacagcggtatcaggcgagaatgtttcatgagcggaacgcgggcggtcatgctgcgtcgagccgcatacaggacaaggctttccttcgatcagtttttccgataattcttttgttaatgcagccgttctcgcttcctctgagcgcctgcggagatcggcttgcgttttttcagcccgttcggctgcggctttcagtgaacgttccgtttcacagaccatatggtaaacggtttgcagcgtttgataagcgcgcgtaatgtcttcctcttccgttttcgctttcgctgtgagcgactcgctttctccgttgagcttctccacgtttttcagctgcgttgtcagattggcccgctctttcgtgatttgttcctgtgtctgctgaaagcctgccgccagctgtgctgcggtctggcattttttccgttcatctgcggtcacttgaactgctttcagctcttctttcagctcattctgcctgttttggccgcgggtcaggcggtctttcactgcggccagctgtttcgaggcggcttcgtattcttcctcttttttgctgtgctccgcatttgttttttccgcttcttttttcgcttcaagcagtttttgttcaatggctgaaagtctttgatacagctcttcttccttgacaagtttcggctcctgttcggccttatgggcgcgccatgcttcataggcttcattttgccgggtaaatgaaacggtttccgcctctgatttccgtttggccagttcgtgttcctgttcggctcgctgcttccggcggacggcttcggtgcagcggtctgcgtacggctcaagggcgagagctgtttccgcctctttaagacgctcagtcaaatccgtgatgtacgggcgtctttcctcaagctttttctcccggcgctcatattcatctctttctgtctgcaagttccaaatttcctggtgattttcaaaacgctcttttgcccggacccgtttcttctcagctgcttcaagccgttcgttcgcttcgtgaaactgctgttcagcctgcttcagcgcatcttctcctgcgtctccgaggccggattgttcggccagcatttcattttttttcgctgccgcttcctgcgcccgccgccgcaattttttgacaagcctgtcccgtactgttccagattaaacagacgctggagcatatgtcttctttccgcgcctttaagcgacagaaactcggcaaactttccttgcggcagcacgacggctcttgtaaagtcgtcaatggtcaggccaagaagctcctctacctttttgttcacttcattcgctttatcggccagcaccgtttgttcgtctttgatttcaatcagccggcagagggcggtttttactttcgtttcatccgttctcttaaaaacgcgctcgaccttgtaggaaacccggtggccggattgaagcgcgaatgtaaatgagacggcaagctgatcttcggcatgattcagaatgccgtgcgtattatttgcggcgcgctccacttttccgtataaagcgagtgtcatggcatcaaggatcgacgattttccgcttccggtcggcccgaaaatcccgaacaccccggctcctgacagtccggcaaaatcaatggtctgttcctccctgaagctgtggagcccttttatcgttaacagaatcggcttcatgtcgcatcctcctcatcatctgctgacgcaagctctaaaaacagcttgaccatctcctcatccggcacgccgccgcccgtttgtttttcataaaacttcttaaatcgatcctcaattgatgtgtgtttcacttcaatccggtcattttcggtctctttttcttcaaaaaccggcctgatatggataaagccgggatgcgcctttctcagccgatgaatttcctcgagagaaagctgatccgtcaaatggatatcaagatcgatccaggcattccggtcacgcccttcatcaagccagccgtgaacctcgctcagcccctgcgctttccatttgacgagcggtttaccggaagacaggaaaatctcttcccacttcgcttctccgccgggcttcgcttctaccactgtcaccgatttggcataaccggcttccgaaaagctgtatgcgagcggagagcctgaataacgggcagccgtcttggcgcgcttgatcgtttgcggacggtggagatggccgagagccacgtaagccgcatcagccggcaggctgtcagcggcgaccgtgtaggcgcccccgacttcaatcggacgctctgaatcggtctgatttccccccgcgacataaatgtggctcgccgcgattttcacggcatcgttccggcacagtccgcacatgtgagcaaacgcctctctgattttcacatcgtaatgatcgcgaagaagcttttcctcaaacgtatcagaaagcacttcgtttaatctcgcctctgacggatatgccagcgcggctacggctaacagctcgtccgccgacggcacctcaatatggacgggttctgtccgcggatagccgattaaatgaatgccgcgctcatttgttaacggagaagccgccgccagcctgtcgggattgtcatggtttccggcaatgacgacaaccgggcgttttccgccgtcagaaagcgcggaaagactttcgtaatacaattgttcagcgagcgcaggcgggttgaccgtatcgaatacatcccccgccataatgaccgcatcaatgttttcttccttgacaatggtattcagctcttccagtacttcggcctgctcgctcagccggcttctgccttccagcgttttgccgaggtgccagtcagctgtatgtaaaatgcgcataccgcattcacctcactttttgatagaaaaaaagatccgctccaaaaaggagcttcggatctcgttacagtgtaagaacgtgacctccatcgaagaaatagagcgcacgccctttcactttcgtttttgtaatttgttcaaccgcttttgtatacaattcgatttgtgtttcatatcttttttgcagaatcggagccgcgccttcaaatccattccggaatttcccctctatccgatctgttttatagtccagcaaatagagaccgtccgcagtttcgtagaggcagtcaataatcccttgcacgagcagcggttcaccggccgtttcggcatccttgtacacctcgccggccggaagcgccatactgaacggcacttcccggtcaatccgcagcgccccgagaaggtctttaccgatttcagttccgaaaaaccggacaatttcttctatatcaatggcttcctgctgctcttctgtcagcagctctttttcgtaaagcatccggaccgtccgctctgcttcttcggcagtcggaatgtgcgtcagcggtatgtgctgcatcaccgtatgcatcgccgtccctttttcggcggctgtcagcccttttttcatcataaaaccgggacgcctgtataaaagcgtgtctcctgacggtttgatgagagagcggccgctgtattcatcctcgtactcttgctttctcttcagctcagaaactgactgcttcgttctgatagccgtcagctctcggtacggatattcccatttaagcagacggcgcgcctgatcatcaaatgaaaacgaaccaggaatcggctcgccctgctgtatcgccttgagacgtttgctcttttcttcagcacgttcttttggattctcttccagcaattcactttgctgcagcatccggatgtgaaaacgcgacgggtcgcgcgcgatatcctcagacgaagaaagtcccggcgtcctgtgcgcctccatgtcacggtggcggatgagcgccggcccgataaagtccaaataagatgacgcctgatagcggtcgaattcagaaagaagccaatcagcccggtctgcttgggcctgccatttggccagctgtttttcccggtttttgcaggaaccgacgagaaacagcttttccttcgctctggtcagcgccacatacaatacgcgcaattcttcggataagagctctctgcgcatctttttcttcatcgccacaagcggaagagtcggatagctgattctgagttccggatgaatatacttcgtgccgaaaccgagctctttatcaagcaggtatgatttgttgagatccatcatattaaaacttctgccgagtccagcggtgaaaacgacgggaaattcaagtcctttgctgctgtggatcgtcatcagccgaacgacatcctcctgctcgctgagcgcacgggcggtccccagatcatcgccgcgctcctgcatccgttcaataaaccgcaaaaagcggaataacccgcggaacgccgtcgcttcgtacgagcgcgcccggtcatacaagacgcgcagattggcctggcgctgctttccgccgggcatgccgcctgcatagtcaaaatatccggtatcgcggtatacttcccaaatcagctcagacaccgaatgattcgtcgaaaatgaccgccacttttgcagactgtcataaaaggttctcagtttttgatacagttcatcatgcctgtcaccgttcgctatatatgctttcagcgcttcataaaacggcgcttttttcttttcaaggcgtatcagcgcaagttcattttcgtcacagccgacgatgggcgagcgcagcacggaagcaagcggaatatcctgatacggattatcaatcaccttcaagactgaaagcgccgcagccacctccacggcttcaaagtaacccgacgtcaaattggcgtacaccggaatgccctggtttttcagctcttccattaattgcggcgcccacggcatggagcgcagcaaaatcacgatatcccggtactggatattccggtgtgtttttgttttcccgtcatagaccttaaacggagacgagacaagctttcggatctccccggctatcgctttcgcttcccaatgcacggtttcaaagtcttcggcatcctcggagctgtctgcgtcatcagcgctgtcaatcagcagcagttccgtttttgccgcgtcattcggcggatacgatgcgccgagcttcaatgccgcctgttcatcgtagtccacttcgccgatttttccgcccatcagctgcttaaacaagaaattcgtactgtccaaaatatcggaacggctgcggaaattttggttcaggtcaattttctgccccgcgccttccccgctttctgtaaaccttttatatttcccgagaaacagcagcggctcagcaagtctgaaacggtagatcgattgtttaacgtcgcctaccataaacagatttcccgcctcttcatccccgcttttcacaagctgcaggatagactcctgcacaagattggtatcttgatattcatcaaccagaacttcatgaaactggtcttgataataaacggccgcttcgctcggcacccgccggccttcttcatcaaccgcagttagaatcgccaggcagtaatgttccaaatctgagaaatcaataattgatttttcttgtttcgccgcttcaaatcgttttccgtacgatatcacgagctgaacgagcgtttcgatgacaggcttcatatctgttaaactcttcaagtgatcttgcggacttcttgtaaagtaatcggtctttaacttttcgatcagtttcttcgcgccgtttcgcaaatcggtcgcttcgtccaaaagcgctttgtcaaattcatcaccctttaccggcttcgcccgcttaaatgagactgcggggacccgttcatacagcgcatcgaagtcatgccggcagctgatcagctcttctatctgctgaaggtcatccagaaaattaccagcgcgcggggccggcccgccgggcgcttttgtcagttcaagcgccttctcaagcttttgttttgccccgaagagcgccatttccgcatcttctctcacatactggtaaaacggaagctcttccattttgctttcttccgtcacgtcatacaagcggacaaagctctgcagccacgcttccgggtcaggatgcgaccgggaatactcgtacacccgtttgacaaggtcttgaagatccagatcatgcctgtctgtcgtatatctgtctgcaagctcaaaaaacgcctgattcccttttgcgtattcatcttcaaacagctcatcaagcacttcgtctccgagcaattcgccttccgtctggtcagccatgcgaaaaccggggtcaagatcaatcatataataatattttttaagcacttgcagacagaaagagtgaagcgtcgaaatgctcgcccgatttaatagagagagctgccgtctgatatgcagagatcccggatttttggcgagctctttttctaatgcttcagcgatccgatgcttcatctccgctgctgaggcgtttgtaaaggtcaccacaaggagcctgtcaacatcaacaggatcttcctccgcggttatctttctgatcatccgttccacgagcacggccgttttacctgatccggctgcggcagcgacaagaatatcgcggccggaagaaacgatggcgctccattggtcatccgtccatatgctgtctttcggtttaggaatttgcatcatcatccgcctcctttttcagccaatccagtatggtgccgtctttttccgctttcaggctgcggtattcattttccttaagcgactcatcaaactggcaaaccgatttaaacgcacagtacgtacaaggcgtcttatctttcagcttatacggggtaatggacacaagcccgtccgttatcgcttcgcccgcctgttcaaatgtccgccgcacgtggtctgtcagcagatgaaagtcctgttcgctgaccgccgctgagtcggatcttaaagacccgtcctttttcaaaccggcattgacgatatttgaacgcccttcctccaaagtcgtgtccatcaggctgatcgcctcccggtcaccgaggagaaggcctttcattttaaatttcttgaaaatttcctgctcgatttcatcaagccccatcggcagactggcctgaatcatcggatcatggatatggaaatacaaaacgcctgccggggtcgctttcatgccgagccaatccgcagaatgtgtaatcgataagtcaagatatgtgagcatttgcagagcgagcccgtaatacacctcagccagatcaagccccctgtcgcttgatttataatcaacgattctcagcagcaggccttttgaactttccgctttatccacgcggtcgatccgtccgacgagttccatcgtacagccgtttttcagcgtgaaagtgagcggaggcagcggtccgcttccgccgaaaccgagttcaagaccgaccgggacgaaaccgctcgccttcgcatgctcgcttaatatgccagaaacacgcgtgacgatcttctgcagtttttccttcacgtaaaagtgtctgtttgagctgagcagaatctctttttgcagctttggcgcaagccgttccaccgcttcataggagaaattccggcactgatctttcgtcagatcgcgccattccagcttctgctcacgaagccggtctgaaatcagcttcagactggagtgaaacagctggccgatatccggcgcttccagcttgaaaaactgccgctcttttaattgcagcccgtgagatgcaaaatgagaaaactggcaggcattaaacgcctccatccgggaaacgcttcctttaatatgctcgccgtaaagctggcgcgaaacaggccgttcaagacgcttcgcctcattgcggaaaaataggcttgaaaacagctttttcgcacgctggtgatcagactctttcatcagcacattgtatgcgctccaccatacgtcactgatctcgtactctcttgtccacagcctgagctgacttgccgtatacgtctgagccacctgtttattgacgagatactgaagctgctcttcttcgcttacctgctcgggatcagccgctgacagcttttcctgatgatcgggaaacagctcgccaagcctgtttacaacgattgacggcaggagcgtttttccttccgcatcggcaatcgggtatgacacataaagacggtcagacggactcgacagcgccatatagatgagaaaatgctcatcaagcagccgctcacgccccgcggaagacagctccactccgaccgctttcagccactcccggtcatcatcagacagcacgccgttttcatccgggcgcgccggaagaacgccgtcattggccccgatgacgaatgtgcaggacgtgccgtatattcttgagagatccatattccctacaaatacttggtcaagcgcaggaggaattaaagaaaaatgaagcgattccgttcccgtttcaagcatttgctggaacagcgccaaagatatttcatcttcacccatcatgccggcaaactcctcgagaagctggataacggcatcccacgcctggccgtgctgctgcgcttcgatcatgtttccggcctcttcggcccgctgccttttccggtccagcttcaggggaacatcggtatcttccaaaaagagataaagagcctccgccatgctttgaaccgttttcgcttttttcatccggttctgcagccggataaggggtgcagctatccactctctcgtctcattcagcatgtgttccatctcgatttcctgatccgtctgcgcgaaatcctcatcgagcgatacgaagcgcctgtatacaaaccgctcgccgttcgtccagcgctcccctttaatgccgtaggcgatacagtaattttcaagctgatctacctgctctcttattttctgctccggctgatcaagcgggaataacagttcggttttcgcacagcggaacaccgcttcatatctccagttccccttcacgacatccaggcttgaacggatgaattcaataagcgggtgatgctgcatagaagcttttccgtcaataaaataaggaagcccgtaatcggcaaacacttccttcagcaaatctttataatcttccggctgacggatgagaatcgccatatctttgtaccggtatcctccgtcccggacaagcgattgaatttcccgggcaataccttcgagctcagctcttctgttttgcgcctgcatgacggtaaaagcttcctgtccgccggtatacgcggcggcgggacgcacatcgtactgcgactctatacaggcaagctccggcacatgccgatgccgcttcgtgccatgcagttccttgcaggaaatatcggcattcaattcctttgccgtctgataaagcttatagtatgtgcttcccgtcattctgaacagatcgagctcatccggtgcctgttccgccgaagggctgtccgccgtcagcgagaatgtgacatgttcagcatgcatgatcagctgctccagcacccttaattcctgcggcgtaaattgatagaatccgtcgacgtaaacacgggcgccttttacaacgtccgccaaaggaatctgctgagcgagcagcgtcaaatagtcctccgaatgcagatagtgtccggcgaggcttctttccatctgctgatataaaatgcctaagtcatgaagtttttcagacagcatccgctctccgcgatactctgacgccgttccgctttccgccatgcggcggacgtcttcaggctcaatacagtatcgcttaaactctgtcagcatccgttccacctgctcagtgaatccggctttgtcactcgctttttgatacactttaaaatcgtgcttatgttcttcaatcagtttccttaaaagcatctgcacacccgtcgtcgtcacaaacggacggttcatgcccccggtatgctgaagcacgcgccacgccaaacgcgaaaaactgaacacttgagcgcgtatcatgcctccgatatccggcgttttagcaagctcatattccattaaaaacgtcatttgatccgggactagaaaaatgatcggtttcccgaacggctcccggcgcagttcatcttgaatgctgtcgataatcagcctcgttttcccactccccgatctgcctactaaaaactcaacacccaaattagaagacccctctctttttatctttctacattttatcgaaagttgacgaaaatgaccaatctcatctgctggtaaaaacgggatgactgttttaaaacatatcgtttttgaccaaattaaagaaaaaaaggattaaatatgatgtcagaatatcccgaagtgattgtgcgaacgattctgtcgttcagcattctgtttatcggcgcccgtatactcggaaaacaaaccatttcacagatgacgctttttgatttcattgcggccatctcgctcggcgccatcacagccaatctgtcgtttaatacaaaactgccgattcattttactgtcagtgcttacacgatttttgtggttatcatttatcttgtcgcatatctttctatgaaaaacagaactgccaggggtttctttgcaggcaaaccgaccattatcattcaaaacggaaaaatacttgagcataatatgaaaaagatgcgctataccctcgactacttgaaccagcagcttcgtgaaaatgatgtatttgacatttctcaggttcagactgccatcattgaaacaaacggcagcatgtcagtggaggtcaaaccggaatttgcgcccgttacaagacaggatctcggcatctttgccggacatgaaaagaactttgccgttgagctgattatggacggccggctggtaatgaaaaatctggaagaaaaccacgtatcggaaaaatggctgagagaagaattggataagagaaacctcaaaccggaagacgtcgtatacgctgtgcgcggaagcaacggccggctttttgtcgacacatacgacgaccatattacatcgccgctggatcaagaataaaaatgacatccgcacatgtcacgggctgccgccgtataataccctataaacatccgggggtgagtccaatgcacgagaatttttttcattatacagccatctgcagtgacgattctgtgcttataaaggatctggtaaaatccataaacggtgaatacagcgctgtgatttgctactcaatattagccgaaaaagcgccgaccgcagaaatcagaagacgaatcgaacatatcagagaggaagaagtgcgccacatgcacgctttctcttcactgtatacgtcaattaccggaaaacagttgacgccgaaacagacggagcattgtccgcacacatacagagaaggactgagggcggcgttttatgatgagcagaaaacgaatgatttttatttacaggcatccgatagagcggtgcatccggaagcgaaacggttatttgcccgcacggcatttgacgagcagcgtcatgccgtctggtttttatacgatatggcccactctcctttccaccatacagggggaacggtatcaaactcgccgaacacaagctacaccgaggtaaataccggaaaataacgattcagacgctccccgctgggagtcatagacggcaaaccccgttctttcaacaggagagaatggggtttatttttcgagccgtttttatacttccactaaacaatggataacttcttcattgtatagtcagcaaaaaccctttataataaaataaaccaactggtcggttttaaacgaaccgagccccgctttgccgggacaacgatatgaatgaggcggaaaggatctgtgtgaagtgacaaatacaaaaggcggtgccggaaagagcgaaaagacgaagaacaggctcgtatccgcttcgcgtgacttatttgcaaaaaaaggatattcagaaacatcgattcgggatattttagaggcggccgagatcagtaaaggcaatctttatcaccattttaaaggaaaagagtttctgtttcttcatatcatggaagaggatcaccgcgtgatgatcgagacgtggagggaaatggaagctgatctgaaagatgctgccgaaaagctgacgggctttgcggagctgctcagccggatgagcatcaattacccgcttatgagagcaagtgaagagttttatgcgagtgcgtttacgtcagaggaggtcgtaaagcggctcaacaaaattgatattgaatatgacgatgtgatgagagagatcttagaagaaggaaatcaagacggaagctggtccattcatcatgtcgaatcaaaagtaaaaatcctgctatccgtcttctacggtttagatgtgttatataaaaacgataccattcagcaaagaatcgaattgcaaaaagaagccatctccgtgtttattcacgggtcgatcaacgctgataaactgaatgacagctgacaaaggagaaacaacatgcaaaaaccgatcagagaacaaaaggctgtactcatcatcttattaagcaacatatttattgcgtttttaggcatcggattgatcattcccgttatgccgctgtttatgaatgtgatgcacttgacgggcagcacaatgggataccttgtcgctgccttcgccgtcgcgcaattaattgcatctcccattgcggggagatgggttgaccgtttcggcagaaaaatcatgattctcgccggactgtttttgttcgcattatccgagctgaccttcggattgggcacacatgtctccattttatatttcgcaagggtgctggggggcatcagtgccgcttttatcatgcccgccgttacagcgtatgtcgcagatattacgacggtgcaggaaagatcgaaggcgatgggctatgtatctgccgccatcagcacagggtttatcatcgggcccggcataggaggatttattgccgatcacggcgttcgtatgccgtttttctttgcggcgggaattgcatttatcgcagtgatttcctctgtctttatgctgaaagagccgttaactaaagaagaacgcgcaaagcagatggaaagcgccaaagaatcaaccttcttaaaagatttgaaaaagtcgattcatccaagctacttgatcgcctttatcatcgtttttgttttggcattcgggctgtcggcgtacgaaacggtattcagcttatttacaaaccataaattcggcttcacgccaaaggatatcgccattattattacgttcagctccattgtggcagtcctcattcaagtgctcgcgttcggcagacttgtcaacttcctcggggagaaaaaagtcattcagctttgtctgatcatcggcgctgtgctggctttcgtttctacggtgatgtcagggtttttgcccgtgctcgctgtcacctgcatcattttccttgcgtttgatttactgcgcccggcactgactacttatctatcgaagatcgcaggaaatcagcaggggtttgttgccggtatgaactcaacatacacgagtttgggcaccattttcggcccggctctgggcggtattttatttgatatgaatattcacttcccgtttctgttcgcaggtgtggttttatttctcggtctgggattgacgcttgtgtggaaaggaaaagcgggcgaggtttcggagtagggtgcactcacccatctccggagctttttttatgttttcgataagaaaaatgaatggattatgagaaataattcattatttatttatctcaaaatctatactatagtaatagtaaggttaacgagcttaacaatttaatatgaatgtttcaggaagaagggttttcattgaagaaagacaaacatctccttacggatatctggtttattctcatcagtgcggcagggggtttcttctttcgcttacagggatgtcgatcgcctggatgctcggaacgcttgccgccggctgcatcctctccatgacgaggcccggctggctgttcatggcgcctgacagaagagggattcaccgcagatggcttgcggcgggacaaatgatcctcggcatcgaactcggccagaaattgaacctgtccgttctgtcggttttacgggagcattggcttccggtaggcttcatgctgattttctctatcgtgatggcgcttgtttccggatatgtgctctttcggttcagccggacggacatgatgacaagctttgtaggaacggcgccgggcggtttatccgccatgccgggtatcgcccaggaagtcggcgcaaacaccgcgattgtaagccttattcagctgacgcgcgtccttttggtcgtcatgacaataccgtttctcgtcattttcttatttaccaaacaaaacggtgcggctcagacatcagccggagccgtttcagcaggagcttcacatccgggccttattcccgtcttgttaacggccggatttattttagctgcctggcttgcaagtaaaggcgcaaaacggctgaaattccccgccccttggctgctcggcagcatgatcggcgttgctgctgcggaaatcggcgtgtccgccttggcgggcaaagacatgctggcctggtggccgccggaagcgaaccagctgtcacaaatttttctcggcgccacaatcggatcaaaaatgtacaaaagcatgttcaccggtgtgacgagagtgctgaccgtcggatttatttcttccgtcggattaatcgccgccatgattctgagcgcggttgcggtttctaaattaacgggcatctccatgattacatctgttctcgccttttctcccggcgggatcgccgagatggcggcgacttcgatcaccctgcacgaagactcgactttcgtcgtcgcggttcaggtcatccggatcgttctcgtcatcgccatgcttccgcccttctatcggctgctgcaccacctttctcagctgaaacgggcacacggcgaaagaggccgggcagaaagaggaacatgatccgaataaaaaaacacgcatccatatgcgtgttttttatttgaacagctctccgccgccatttacagaccgccagtttgctgacagatcacggaacagccgttcagcaaataacagttcttcatctgtatagcggtctaaaaacgccaagagccgctgttttatcaattcatgatattcatgatgaagggaatgcagctctttcccggcaggagtcagccggaaatagacttcttttttattgtcactcagccgggttctgcgcagaaagccggcttccaaaaacttcgcgcagcttctcgacacggtcggctttgtcgtcttcattttttccgctattgacgtgacattgatcggttcatgatctccgatacacgacaaaatgtgaatttccgtcaaggtcaattgtaattttttcccgtttccttcgcggagttcatccatccgtccggccaacgacgccctgatatcctcctgacacctctcctgctcgtgaaaaatatcggtcagcccttcaagaatcatgtgttttgcatggtctggctgtcttctgtccaactgctgagtcacccttccgtattgattgtttcttttactataacgttttgttacataagaaacaatcacacaggcgcataaaaaggttatcagatgaataatccccatctctccaaaccggccagaacggcttcttccgcttcacgtcccgagccgccggctgcccatgccgcatggccgtccggccggattaaaacggtgtggacgtcattccaatcggcacgtgtttcagcaagctccgccctgactgccgccacgctgtccgtatcaataccggcgggaatgctccctcttaatgacagaagcacaaagccgcccttgcggagaaaatcatacagccgggccggccgcccgtcatgaagggtcagttcgatatccggcaggcgttttccgttcagggtatgcggcggcagctccgcatccggttcataatgcagatcaagcgcggatacttttcccgccaataaacggttggactcctgaaaatccagcaaagcggtcatcgtttctcttaatgccatccccgactcggtaaaatccatgagctttatctgcgttttgatattgtgcagcacttcttttcctgtgctgtgcctttcctgatgatagctgtccagaagatgaggcgccgcttttcccttcatttgcgccgccagcttccagccgagattgacggcatcctgaagccccgtattcaggccttggccgcctgcgggaaaatgaatgtgcgccgcatccccggccacaaaaatccggccggagcggtactgctcagcctgacgctcggcattgccgaaccgcgacatccataccggatcactcaatccgaaatcagtgccgcatatccgccgcaggtcttctttcagctcatcttcggtgacccgctcttccttccgcttttgcgggacatgcggagaaacgatgaggacacggaaaagtccgtccgtaagagggataatcacaaccgatccctccagccggcacgttgaaaaaaaggaagattcgggcggatgtttcaaagcggcatcacaaagggttcctgttaagtcggcatcagtgcccgaaaaagcgatgcccgcctgtttccggacaatgctccccgctccgtctgtacccgcggcatataagctgtgaagagtgcggattccgctttcgtcccggaacaccgtctccactccgtcatccgtctgggtgacagccaccgcttccgccccgcggatgatgtctgcgccgagacttgatgcatactcctccaacatccgctccgtttctgcctgtggcagcattaacgaataattctgcttcgtatccagccgagaaaaatccagccgtgtatccagcatggaaaaatggccggaagacaccttcgtccctttttccaagaagcgttccaatatgcctctcatggcaaaaagctcaagtgtgcgcggatgcatgataagcgctttggaatacggcatcgtcttcttcaatcgttcaatgacagtcgttttcactccggccagcgccagttctgatgcaagcataagcccgaccggacctcccccgataatggcagcctgtgttttcatttcatcagccctctttcatatttttgttgcgcgcgtaacaaaaatatgaaaaataaaacacctccttttttgtttcgcgcgtaacaattttcattatagtctttcctccgctttttgacaatcatttccgaaaaaaagacgccgttcacttggcgtctgattcactgatgactccgacaatgtctttatccttaatcggaccgaaatgacggctgtcgaggctgtatatgcggttgtcgccaataacaaagtattgtcccttcggtatgcttttgcgcccggtcgtttccttcagcgtataatcaccagtcacatggctcccggcggacaatgatgactttaacggttttaaaaacggttccgccacccgttttccattcacatacagctgatcctccctgtatgcgattgactcgccggggagcccgatgacacgtttgatcagcactttgcggtgcgggcctttaaacagaacaatatcgaaacggcggatcgttttgtaacgatgggaaaacttgttgaccatcagctcatttccttgtttaaaggtcggattcatgctgattccttcgactttataatcaataaaaatggcattctttaattgtatggccaaaacaacgataagcacgccggctataaaccaaaatcgttttttcaagattcctgtctccctccgtctttctcatgctgactgattctcgtctgtaaacgccgttcgatatgctttccggcataccacagcaccgcgatcaccattatggcgcccgccatcctgaaaggctgtgtaatgagtgcgtgaagatcatacccgataaaactgatcataaagatcataaccattttccccatcgcggctgctgatataaactgcagcgcccccacccgtgacagaccggcaacgatatgaaccgcagcggacggcgtaaaggggaagcaaagtaaaataaacagcggaccgaaaccgtgccgctcaacccagagcatcatccgccttatggtctgatgcctgcggatgaaaccgaaagctcttttctgtccgaaacggcggacggcataaaacatcagcatcgatcctgacgcagacccgagccatgacagaaaaaaaccttcccacaaaccaaatgcattcgtattcgccaccacaaatacaacgagcggcaaaaacggaagaaacgcttcaataaaaggcaatacagccgcagccgccgggccgaaagctctatagctttggaaccattccgtcagctgttcctcagtcaaatatgataaaaaatgctccaacgtttatactccttaacgagtttgtctatccttattctacacattatctccaaaaaacgaaaatgtttacgagattttccgtcttgaaatatcgtgtaagcgagtataaaataagaacaaacgttctcttttttaagaaagaaggagtatttatgcctgacattcggagcggcacccgcgatctcatcgaaaaagggctgtttctgcccatggcggccgccatcctgaaccgggacctcgaagcgcttgattcgtgcccgttcaaattaaaacaaccctataaacagcttatcagctgctctttaaaattagcacaaaaggatttgagtgatgttcgaaaagagttaagaaagcgtaaaattaaaatatacgaagcggaaagagacgaagcatttacgctttatatatgcaccattaacggctatgaagaaaaacaccgttatttcaacccgagaatacgggaacaggtcaccgccttattggaatattacctgtctcttgcgaccatttaaaaagcagccgggcctgcttttccttttcaaaaaataaaattcagactattcacactatacattcgacatgattttctttataatcgggacacgctgttttcaatgaaaaggaggaatgttatgaaactgattcatgttctcgccgccctgccctttttcggaattctcgccggcattccatttgccaaccgggtgacgccttatgttttcggaatgcctttcattctcgcatatgtcgtcatctgggcggtgctgacttccgttctgatggccgccgtttacaaattggacaaagaaaacaaggcgggtgagacggaatgaatgcagcatttcccgtaatggccgccgtgctcctgttttgtgtatatctcggaatccgggcccgaaaaggaaaacatatggaccttgaacaatggacggtgggcggacgcggcttcggcacgatgtttgtctttttattaatggcgggagaaatatacacgacctttacattcctcggcggaagcggatgggcttacggaaaaggaggccccgccttttatattatcgcgtacggctgccttgcctacattttgtcatattggcttctgccagccgtgtggacttacgccaaacaacacaaactgatgtcgcaatcagattttttcatttcaaaatacaacagcccgctcctcggcattctcgtatcgctcgtcggcatcgcatccctcatcccctatctcgtcctgcagctgaaagggctcggattaattgtttcagcaacgtcatacggacagattccgccctccgccgctgtctggatcggcgctgtctccatcacgatttatgtgatgatttcaggaatccacggttcagcgtggatatccgtcgtcaaagatatcatgattttaggcatcgtcctgtatttaggtatttatctgcccattcattattacggcgggtttacggagatgttcaaacaaattgacgccgcaaaacccggttttctcacgctgccggaaaccggacagagcgtttcctggttcagctcaacggttttgctgaccgccctcggcttttatatgtggcctcatacctttgccgcttcctattcggcggagcatccgcgggtgtttcggaaaaacgcgatcatcatgcctctttatcagctcgtcctgctgtttgtcatctttaccggatttgcggcgattctgcaggtgcccggtttaaaaggggcggacacggatctcgccttattaaagctgtctgtgaaaacctttgatccctggtttgtcgggctgatcggatcggcgggcatcctgacggcgcttgtacccggttcaatgatattaatggcctcaagcacgctgttcgccaaaaatgtgtacaaagccattctgcccggcacgactgacgaaaaagtctcacggctcgcaaaatacgccgtacccgttatcgcgctgatttccgtatattttacgctgaaaggcggaaataccatcgtcaccttgcttttaatgggctacagccttgtcacccagcttttccccgccctcttattcagcctgccgaagcggcgtttcatcacaagccacggcgcttttgccggcataacggccggggtcggaacagtggccttcattacgctgaccgaatcaaccgtcggaaccctctttccgtttcttccgcagatcattaaggatatgaatacaggcatcatcgcgctggttctgaacattgccgtcatgtttgccgtcagcgccgcagtcagaaaaaaacaaatcagcgcagccgaaaaggcggcttaatgataaaatagcggtaagacacatgaagggggaaagccgcatgatcatgacaacgaccgaaaccgtcgccggaaaacagattacggaagtaaaaggcttggtgacaagcagtatcgtccagtcccgtcacatcggaaaagatttgcttgcaggcttaaaatctgtcgtcggcggcgaattgaaaagctataccgaaatgctggaagactccaaaaaagcggtgaaagagcggctgatcagagaggcggagcagctcggagcgaacgccatcgtcggcctgcggttcgaactgaccgcaggacagaacacatccgaattaatcggatacggaaccgccgtcaccgccgaatccatttaaaaaaacaagcctctttagagaggcttgtttttttatttctcacatgcgatatagtctttatcccggtcaagtcttttatttgcattataaagcgcttttgatacatacggcttgtactttgttctgccgcccttgtttttcactttcgacgatttggccacgccgcccttatacaccttattcagcgccttacagttttgatacgtttttacctttgttttcgcttctgccgtctgccccgctccgtatgaacaaccgaacaccaggccgaaagacaaaagcacagctgccgtctttttcatttctatcctatcccctttcctgaatcatgttgtatgactgaacatatcatagttcaaataatctccatttacaagataaataggaaaatagttttaatttacgtccgcccgtatatcttttatggaatttttcccaaaaccttttataatatgaattgatagcgctatctgactatgatgataggaggagaaatgatgatgaaaaaagggcttgttgcgggtgttctcactacagccgttctattcggcgcatgtacggcggatattccgggggtgatcagtcccaatacggcggaagcggcgtcccagctcagtaaaggaatcggcggaagggcctatctgaacagcacgggctcagttctcgtcacgaaaattcagcttccaagctcgattcaggtgtcaaatgggacagcctatatttactcaggatttaccggaggcacagaggctgatatcgggcttcagtacagtgacacctatcatgtatggaaaccgatcatgaaagtcggttcaaagggacaaggccaggtccggtatctggaaggagaaagccaattcacttatacgaaaggcttccggcccggcagcaccgtacagctgaccatttacaaaaatctgaacggcaatacccgcgccacatattggggcacgaataatgacggatacaccggccgcatcatctcagaactcgcccaaaccaatgtaggctctgtctcaaaatggaaagcgctcgccaccgtcgcggtcacatcagaggatcagcgcccttacatcaaatcaaacttctcgacagcctttacgaacatcacgatcgacaataaagcagtcacacctgtgattgatacacaggattttgccaaattgacagtgtcaggcagcaccgtcagcatgtctgtcgtcaaataaagaattttgaacgcacgatttctttcatcgtgcgtttcgtaagggtctgccggatacgcaaatcccttatttttcggattacgtttaataaaaaaacagccctcctcagggttgtttttttaacatttctttcattatttccgccaaaacgctgagcagtccgccttatccttgatattaaattgaatcatgcgttcaagcagctcataatacaccggttcagtccattgaattctgaacaaacgggaagtagcgctgtagccggcacgggcaatgtcgtcggcaaaatgcgcaattccagcttcttcgggagaaacacttacatgatgctttgctgccgcaaagccgataataaaggtgccgtgatcggtaaacatcggcgtgttccacttgatctgcggtgttaaacccgggaattgctcagacgtccacgacaggatttcctccattcgcagacgatggtcagggctgtcgatacttgataaatagtctttgaaaacgtccatgtcttcctccttcaacatcacgtccgctaacgccaaaaccccggattttcagctttttctttgatgttaaattcgatgatcttcttaagcagatcatagtgcaccggatcagtccaccgaattctgaacaggcgtgaagaagcgctgtacccggcttgggcgatgtcatcggcaaaatgctccatcgtctctttttcaggtaaaatgctcaaatgattttttgccgcggcaaacataatgatataggtgccgtgatcggtaaatgtcggtttgttccacttgatctgcgcttctaagttcggaaattggtcagccgtccacgacaaaatttcctctgctttgagacggtgatccgggttatcgatttctgatacatattttgcaaacacatccatgcccatctctcctaaaatgaaatatcattactctttacatcatcatagccaacagacggacacgatacaactctatccgggcatgtaaatcgaaaaagcccttcccaaaaggaaagggcccgtccctttacatcacagctttctctaatatctctcccccagctcccgcaaaataaagtcgtagatcattcttgtccgctcttctttcggatacagcatgaattcctgccgcttcgggatatgactgcccatcctgtcctgaaaagtggttctgagataggcggttctgtaaacctgattttcaaaagaatgataggatacttccagttccatcgttttgccgtttgagaacgtgaccgctgtgtcatcaaatgccgtcggttgaaaatctttaacgtgcacatgagatatccagccgcattgaggccttgcagaagaaagtgtagggaataaaaagatgtgatttgaagggtccaccataatcggcggcttgtgagaaattttaatcgcttcatatgttcccgcttttctcccggcatagctggagccaaagtagcggcagcttctgtcgatgatgtgaatcggcttcatgctgacatacagaatgcagtctttttcaatgaccttcgaccccattttaccgtctatttcctcaggcaaaacagcgatggttgaacgatttacttcgtagctttctaagggtgcgtgtgttttctggcacatgatgtgcagcctccaatccttttcttgaaaatttatactaataatctatcatctgtaattggaaaacgacaggttttttttgaatatagctaaaaatcaccttttaaagctgtaatttagtcttaaattactatttaaatattatttttctttttcatttcacctcatttatacaatgatcattttcgttttttcgtcaatttgcaggatatgtcgatatatttccaagtattagttatctaaagattataaaaattaattgatttttccggccgttatccatatactataaaaaaggcattggggggattctttatgaaagagaaaaagtcgtacactgagctcatgaagtcccgcaacacggaaaaagcaaacgaattcgatgtgacaatggccgatatttacattcaaatggtgcttgatgaatccttgtataaacgccggatcgccatgctgacaatgcagattaataaggcgcttgatgataaaaataaagaagcgttcctcacgctttcaaaagaatatgccgctctcaaacagagtgaataagccaatccatatggattggctttttttacattatccgtttacgatggtgccgccgttcacatgaatcgtctgtcccgtgacataggaagaatcatcgcttgctaagtacaaatagctcggcgccacttcaacaggctctcccgggcgctgcatcggcacgtctgagccgaagacttccacttccttcgccgagaagctcgccgggatcagcggcgtccagatcggccccggcgccactgcgtttaccctgatgccctgagtgacaagagattgggaaagagatcttgtaaacgtgacgatcgccccttttgtcgctgaatagtcaatcaatgttttgtggcctttataggcggtaatggaggccgtattaatgattgaacttcctcttttcaggtgagggagcgcggctttcgtcaagtaaaacattgaaaaaatattcgtctgaaacgttctgatgagctggtggctcgtgattttctcaatccccggctgcacgtgctgctcacccgcgttgttgaccaggatgtcaatggaaggaaaggcttggcccgcctggcggatgacatcgttgcaaaaggcttcgtcgccgacatcccctgcgatcagcagacacttcgccccttctttttctacatattgcttcgtctcttcggcatcctgatgctcatcaaagtaaacgatgaccacattagcgccttcctttgcgaataaaacggatacggcgcggccgatcccgctgtctccgcccgtgatgatcgccgttttcccttcaagttttttcgccgctttcggtttgtcaaaaacggggcgcgggtccattacatattcaaagcccggctgccggttttgatgctgcggcggcaaggttttcttcttctgattcgccattttgatcactcctttacattaattactatattatgagtaatttgagcatcttatacgaatttcatgtatgaacagagtcttattggaaaaattaagaatatacaacagaggaggtaaatctgaattgactactttttcaaacgaggaaccggcttcctattggaaagcaacagctgacattccttcctttcccgccctcactgaagatacggaatgtgacgttgcggtgatcggcggaggaattacgggcctgacaacggcatacgaactgacgaaaagaggtttccgtgtcgctgtcattgaagcagaccggattttaaacgggacgaccgcgggcacgaccgcaaaaatcaccgcccagcatgatttcatctatgccgatcttattcagcagatcggcctgaccagcgcaaggctgtatttcgaagcccatctccgcgccatggaagacatgaagcagatcatcaaggacctttcgattgactgcagactgattgaacaagacgcatatctttacaccaatacagaatcaggcgtcaaaaaaatgcgcagtgagcaggaagcttataccaagctcggtattgaacacgagcttgtgaaagaacttcccgtccccgttgattgcaggctcggcctcgccatgaagaatcaggcgcaattccatccgcttttatatggtgcggcgctcgtcaaagagatcgttaaaaacggggcgcggatttttgaacagacggctgcgatcgacataaaaaaagaaccgcagccggaagtggtcacgaaaaacagacacggcatcaagtgcagctacattgtctgcgcttcccactttcctttttatgacggaggcgggctttatgccgccagaatgtatgccagcagatcctacgtactcgcggtaaaaccgaaacaagcgtatccggacgggatgtatctcagcatagacaagccgtccagatcactgcgatacaccgatttgaacggtgaaaaactggtgcttgtcggcggtgaaagccacaaaacaggccaaggaaaagaaatgtccgggcattacgaagcgctgaaacaatttgcggaagacacaatcggagttgaaagcatcccatatcattggtctgcacaagaccttgtcaccattgacaaaattccgttcatcggtccgatctcaggcgatgaagaacatattttggcggcgaccggttttaaaaaatggggcatgacaagctcagcgctcgccgcgaagcttttggctgatcatattcaaaacaaaaagaacccgttttccggcctgtttattccgtcacgcttccacgcagatcccggactgaaaaaactgatttcctataatgccgacgtggccaaacaccttatctcgggcaaacttgagaggccggacgcttcgcctgagagtcttgggcccggggagggaaaaatcgtaacggtaaacggcaaacgggccggcgcctataaagatgaaaaaggctgtctgcatcttgtcgatacgacatgcacccatttaggctgtgaggttgaatggaatgacggcgaacggacgtgggactgtccatgtcacgggtcccggttcacacccgacggcggggttgccgaaggtcccgccatcaagccgctgaaacgtctcacccaagattgactaaaccattctgtacgaatggttttatttttttccgcattaaaatatttttatcagattccttcattcaagttccttccaaaccgataaaaagaaaaagagaatatctgggggaactaatattgttatttaaaaaagaccgcaaaaaagaaacagcatatttttcagaagccgatggaaaaaaacgcatcgcgctttcaaatcaatatgcagatgtccaaaaacagctgaaaatggtcaggctcggaaacgaagaacttcatgtgcttgaagagctgcagccgttaattaaagaacatatctcaacaatcgtcgattccttttaccgaaacctggatcacgaaaaatcattaatgacgatcattaacgaccacagcacggtcgagcgcctgaaaaaaacattacggcgtcatatccatgagatgttcgccggcacaattgatgatgaattcattgaaaaaagacagcgcatcgcttccatccacttgcggatcggccttgaaccgaaatggtatatgggagcgtttcaggatctgcttctgtcgatgatgaacatatatgaagcaaccattccggatttgcatgagcttttaaaagcgatcaaagcgacgacgaaaatattgaatcttgaacagcagctcgtccttgaagcattccagactgaatataactgccagcgtgacgaacaagaggaaaagaaagcccgtcttcatcagaaaatccaggaaacatccggatcactcgctgatttgttttcagaaacgagcagagccgtgcaggagctggtcgataaatctgagggcatttccgaggcgtcaaaagccggcaccgtcacttccgtacatgtcgaagaaaaatcaatcggcgggaaaaaagagcttgaaagccagcagcagcagatgaataaaatcgacgccagccttctgcagattgaagaagaaatggacaagctgaatgacatcgcccagcagatcgaaaaaatcttcggcatcgtgacggggatcgccgagcaaacgaatctcctgtcactcaacgcttcaatagaatccgccagagccggagagcacggcaaagggttcgccgttgtcgcgacggaggtaaggaagctttcagaggatacgaaaaaaaccgtttccaccgtatcagagctcgtgaacaataccaatacacaaatcaacatcgtgtccaaacatattaaagatgtaaacggacttgtaagcgaaacgaaagaaaaaatgacgcagatcaaccgtctgtttgatgacatcgtccaaagcatgaaaacgagcaaagaccagacaggcaaaatcgacgttgatttgcaggcctttctcggcggccttcaagaagtcagccgcgccgtttcccacgttgcatcatccgttgattcacttgttatccttacagaagaataaagataaaccgaccggcctttttcataaagggccggtctttttaatgttaacttaaaatataatagagttgacatatataaagactcgctttattgtataaacatattttgataagctggaggaatacataatgaaattgacagaaatgatgcatattgccgtgtttaccgccattatgggacttttggggctgcttccgccgcttttcttatcctttacgccggttccgattacgctccagacgatcggtgtgctcttatcaggaagcatccttaaaccgaaagcggcatttttaagccaattgctttttttgctgattgtggcatgcggagcgcctctcctttcaggcggaagaggcgggttcggggtttttttcgggccgagcgccggatatctcatcgcatatccgctggcggcattactgctgagcctcagcatccaaggccttcgctcagctgctgtcccccatttgtttatcagacagttcttgttcggcgtgctgtttttgtatgtcatcggcattcccgttcaggcttttataatgcacattgatatcttgactgccgtaaagctcagcctcatctatgtgcccggagatctgcttaaagcggccgcagcctcattcgcagccgtaagaatcagaaaaactcttcaagcaagccggcttttgccgacgaaaggaagctgattttagtcatcatgattacatcatcatattcagatacagccggacaagcgccggaacggatcgcaattcagacagacacagaacagatcacctatcaaacttggaacaggctagtaaaccaaaccgcaaactggcttggcagcctttcagataagccggaaaacattgcaatattactgccgaacggcatcccatttttacaacttttcgcaggggcggcgcatgccggctgcacggcggttccgttagatccccgctcggctgcggcggaactcgcggaccagctgcacatcagcaaaaccgacctcgtcatctgtgaccgccggctgagcggcagactggacggcatcaaaacgcctgtcatcctgtgggatgaatgcgggcctttgatcgaggcggaaaaaacggaaggcacttttatcaaaaacaccggcctgcccttttataccggattcacctcgggatcgaccggtaagccgaaagccttcacccgctctcaccgttcgtggctggagagcttttcttgtacgaaacgtgaattcggcatttcccctgatgacaaagtgctggtaccgggcacgcttcgctcgtcacactttttatacggcgccgtcagcactttgtttatcggcggaaccgtcctccttcaaagaaaattcaatccggccggaatgaaagaccggctcagacaagctgacgttctatataccgttccgacaatgacggacgccctgctctcactagaggcgtttccggatacaccgctcaaggtgatttcttccggtgcagactggcccgcttcgtctaaacaagcgctgtcagagcgctatccccatttacggttgtacgatttttacggaacgtctgagctgagtttcgtggcgttcttatcgcctgaagacagcgcccggaagcctgacgcggcgggccgtccgtttgaaaatgttacaatcgaaatccgccggcccggcggggaacgctgcatgccgggcgaaacggggaagatttttgtgaacagcccgatgaaattttccggatacatcaacggcgcaaaacctgatgattccggctggatgacggttgatgacatgggatatatcgatcgtgaaggctatctttatatcgaaggacgtgaaaacgggatgatcgtatcaggcggcctgaatgtattcccggaagagatagaacgtgtgctcaaccgctgtccgggcgtcagaaaagcggccgtcatcggcattcctgatgattattggggcagcatcgccgttgcggtgatcgacggacatgcaaatgtaaaggaactgaagaaacagtgccgcgagcagctggcggcatataaaatcccgaaaaaatggctgttttcagaaataccggaaacagccggcggaaagatcgcccgtgccgccgtacaaaagcaggcaaaggacatgatggaatggaagctgtaattacggatgcgaagcggacgattttcgcccgggaaaacggcctgttaaaagactgtctccccgaagatttggcagctccgctgatccgacatttgagccggaacatgcccgaagacattgatgaagtcctgatcggaaacgcgacgggccgcggcgggaacctcgcccggctgtcagccttggccgccgggcttcctttgagcgtgtccggtacgaccatcgacaggcagtgcggttccggattggacgccgtgagggtcgcgtgccactttgttaaagccggcgcggggagcacatacatcgcgggaggagcggagagcagcagccgttcccctttctcatcccgggcgcgcttttctcctgaacacatcggcgatcctgatatgggcatagcggccgagtatacggcacaggcttacggcgtaacgagaaagatgcaggatgaatatgcccttctcagctatgaacggagcgtcaaagcgcacgaagacggcttgtaccgccgggaaattctcccctgtcacggattcgccgctgacgaaaacatgctgaaaaagcggaacatggggcctctcatcgcccgcgccaaacccgtctttcagtccggaggctctgtcaccgcggccaacagctgcggaatttctgacggggcggcggcagtttgtgtgatggaagaacaaaaagcgcggtctctcggtttaaagccgggattgcgttttatcggaagcgcggtaagcggcgtccatccgcattatccgtcagcagctccggtttatgccgtcaaaaagcttttgaaggaacgggacctgtcaccggatgatattgatatatacgaaatcaacgaggcgtttgccgtcaaaatatgcgttttttcacagcagcttcaagtgccgtattctaaaataaatgtccggggcggcgctctggccgtcgggcatccgtacggggcttccggagcggcgcttatcacccggcttttttatgaagcaaaaagacgcccggatgcccgctacgcagcagcagcgatcggcagcggaggcggagtcggactggcgcttctctttgaagtgttaacgtaacggcagtataatagatgatatcgataaaaaatgatcggagtggagactttatgactgccgtttgtttagtaagacatggagagactgattggaatgcccaaaagaagcttcaaggcaaatcggatattccgttaaatgcgacgggagagcgtcaggcgaaagaaacaggagagtacttaaaggggtccgaatgggatgtcatcgtctcgagcccgatgaaacgggccagaaaaacagctgacattattaacgggtttttgaatcttcccattgtcgtcatggaagatttcagagaacggagctacggtgatgcggaaggaatgtctttgccggaacggtcgaagcgctacccggataaaaactacccgaacatggagaccgcagaagagctgacagacagaatgcttgccggtttagtgaaagttcaggagcggtttcctgatcaaaaagtactgatcgtcgctcacggcgcagctattcacgccctcttgtccgctatttctgacggtgataccggcatacaaaacgcaaagcttgtcaatgcgtgcctgagcaatatcgaacgaattgaaaataagtggcgcgtcaaagattacaatgtaagcagccacctatcagaatcataacaaaaaggcccgaattagttttgggcctttttggcgagcatttttttctgaagatcatgtaatacggcgtccgcaccgtcaatgctccggcgctccgtccataccgccctgtccgcgcggtaaacgtgtccgttttttacggcagtcagctgtttccagaggtgatttttttcgagttcttcctcaccgtccaatagtacgatgtaatcaggatcgatatgcaaaagctgcccgggcctcattttgatagcgtctgatttcccgccggaatccgtctggaccgcatatgtaaaccctgcgagcgtcaaaagccgggatgtgaaaaaccggtcatcctttacggaaatgctgccatttgcagcgtcaattaataaaatcgtgccgccttctgcatccagctttcttttgatgtcattcagcttttcttcctgagccgacaattgtttctctatgatgccctctttaccgaccgccttttcaatggtaagggcagcatcaaccgcatcctgataatccgcagcttcatttttcaaagcgattgtcggagcgatctttgtcagctcatggtatatcccctgtgcaggcttgagtctgcaatgatgagatcgggttttaacgaagtgatttttttcaaatcgggatgtgacgggggcccgacggacggactgccgtcgtttcgctctttccggttatccgccgcggccgccggctttataccgagatcatggagggtgtcaataaagccctcattcaatacggcgatgcgctgcgggtgcgcagccacatgcgccgtccccagatcatgcctgacggcggtttcatgttcctgttctgagcatgccgttatgaagagaacggataagatcatcagcatactgaaaattggtttcatctgttccccctctttcgtttttccgcaattatatcattgacaatataagtatcaatgatattcattatcattatttttataaaatggtttcacagcttttctccctcaagaaagtcaaagactgattcatgccggccgctttatttcattccgctttcgtttccatcagacttctgcattcaacaaaaggtgacatttatcctgtttttgcctcagcttccaaaaatggaatcaaaccgttcgacccagtaaacaagagagcgattgcggctgtgtacaaatactcatgtccttccatcggttttttccattaaaatttaaatatttcgggttcctattaaacgaaagagagatgatatacctaaatagaaataaaacaaactgaaaaaaattgggtctactaaaatattattccatactatacaattaatccacagaataatctgtctattggttattctgcaaatgaaaaaaggagtggataaagagtgagaggcaaaaaggtatggatcagtttgctgtttgctttagcgttaatctttacgatggcgttcggcagcacgacttctgcccaggctgcagggaaatcaaacggggaaaagaaatatattgtcggatttaagcagacaatgagcacgatgagcgccgccaagaaaaaagatgtcatttctgaaaaaggcgggaaagtggaaaagcaattcaaatatgtagacgcagcttcagctacattaaatgaaaaagctgtaaaagagctgaaaaaagaccctagcgtcgcttacgttgaagaagatcacgttgcacaggcgtacgcgcagtccgtgccttacggcgtatcacagattaaagcccctgcactgcactctcaaggcttcaccggatcaaatgttaaagtagcggttatcgacagcggtatcgattcttctcatcctgatttaaaggtagcaggcggagccagcatggttccttctgaaacaaatcctttccaagataacaactctcacggaactcacgttgccggtacagttgcagctcttaataactcagtcggtgtattaggcgttgcgccaagcgcatctctttacgctgtaaaagttctcggcgctgacggttccggccagtacagctggatcattaacggaattgagtgggcgatcgcaaacaatatggacgttattaacatgagcctcggcggaccttctggttctgcagcgttaaaagcggcagttgacaaagccgttgcttccggcgtcgtagtggttgcggcagccggtaacgaaggcacttccggcggctcaagcacagtgggctaccctggtaaatacccttctgtcattgcggtaggcgctgttaacagcagcaaccaaagagcatctttctcaagcgtaggttctgagcttgatgtcatggcaccaggcgtctctatccaaagcacgcttcctggaaacaaatacggagcgtacaatggtacgtcaatggcatctccgcacgttgccggagcggctgctttgattctttctaagcacccgaactggacaaacactcaagtccgcagcagtttagaaaacaccactacaaaacttggtgatgctttctactatggaaaagggctgatcaacgtacaggcggcagctcagtaaaacataaaaaaccggcgtcggccatggccccgccggtttttttattatttttcttcctccgcatgttcaatccgctccatgatcgacgggtggctccctctgaaaattttgacgagaaacggcgggttgacccggctcagtcccgtatcggccaagtcctgaaacgtctcaatcgccgcttcccggtttccggtcagctcgatgccgtaacggtcggcggcgttttcctgataccgggagacggcgttcgtaatcggatcagaagcaaaactgagaacggatatgagcagcaataacagcgggagggcggccagatcttcaggcccctttatatgaagcattcggccgaagaatttggacagccgcttataaagcttgtcaatgatataaaacccggctaatgacagcagcagatacccggccagtccgatgtacacgtgcttcatcacatagtgccccatctcatgccccataatgaacaaaatttcccgatccttcagtttgttaagcgtcgtatcccacaaaacgatccgcttattcgaaccgatgcccgtcacatacgcattcagcgcattcgttttctccgacatatttacttcatacacatggctggccggaatgtcggccttgtcggcaagcgacaaaattttgctttccagctccttgtctttcagcggatagaaatcattgtataaaggatcaatcacgaccggctgcaggaaaaacaaaaacagggtaaacggcacagtaagacaccaagcgtaaaaccaccatttttttgtatgctttgtgatcagccagtaaaacacaagcacacacacggcaaacagcggaaaactgatccagaaatcaatgacatggtctcttatccagcttgctgctgtctgcgtcgaaatatgatacgcaagcgaaacccgatatccgatccactcaagcggaagcgaagccgccgtaacgatgagtgaaatcacaaatacgaagcttacgatttgcagcacccgaaagcgcaccgctgcttccagccaatgctttattttttttgcaagccccgtaatgagcagcagaaaaaataaaaaccaatctaacggcgctccgatgaaaaataaaaaatcctttacatttgaaaagttttcagcggctgccaggcggcccgggtccatgaacgaggacggatcggctttcgttccctttacggcctccgggacggcggagtctcctgtcataaagaaataccaatagaaaaaaaggccgtacagcacataggcaagtcccgctgccgctatccatttgcgcatggaagtctccctccttagccttatgacttactcctattgtaagcataaatgcaaataaatagaaccaagcctccgaaacggatgttaatcttttcacaacagaaaagaatggaacaacaggaagcgggaaagactaaaagacggagtgatgaatatgaaaaaaataatcgcgtttattgtagtaatcgcccttttggttattgctttcttctatgtatacagccggaccggcgatgtgtttccatcaagcaacgcagatctgattattctgtcagagaacggaaaaaaagaaatcaaaattaaagacaggcagaatgtaaaagatatgctcgatatcttgaaccaaggaaaacaagtcaaactgaccaaaagcgtgtctcccgattacgacggaacggtcaaataccatgaagaccgttttgattcattcagtatgtggctcgaaagcggcaattatatgatgtacaagcataaaaacacgtattacaaactgacccggcatgatacgaagcttgtgcaaagcatcattaaggaagaatcgcacagctgaccggatcagcatgtaaaagcgaagcccccggcttcgcttttcgtccgtcatttcggaagcatgtcccggaccgcccttctcagcagcttcccggtcgcgttcttcggaatctcatcaagaaaaaccacttccgccggccgcttatattttgccaaatgtgtttcacagtaatcgaaaaccgcctgctctgtcagctcaccgtccgcaggcactatataagcatgcaccgcttcccccgttttggcgtcaggaacgccgatgaccacggcttctttaatgccctcatggctgtagagcacttcttctacttcgcgcggatagacattgtatccgccgacgagaatcatatctttttttctgtcgacgatataaaaataaccgtcttcgtcgcgcttcgccaaatcacccgtgtacagccagccgtctttcagcgcgtgctccgtctcctcgggcatcttgtaatagcctttcatcacattcggccctttcacgatcaattctcccacttgatggtcgggcaattcgcgtccgagcgtatcgacgactttattttcgacatgtaaaatattcgtcccgatcgagccgggctttctcccccggtcaaacggattaaaacaagtaaccggagacgcttcagaaagtccgtatccctccagaatggtgacgtcaaaggtttgttcaaacgtctgcaacagagcgaccggcatggaggcccgcctgaaatgcacagtctgacggacgcaaaatcctccgccttgccgtgctcgtattgatacagatagttatacatcgtcggaacgccggcaaaaatggttgcctgacggcttttaatcagtttaaacacagaagccgggctgaattgcggctcgattaagacacacgctccgctcatcagaggcgcattcatacaaacggttaaacaaaaaacgtgaaacatcggcaatgccgccacaattttgtctttctcattcattcctaagtatccggcgacatcatttgcattggagaaaagattctgatgggtgagcatggcgcctttcggttttccggtcgtccctgaggtgtataaaatgacggcagtatcgtctttggacaatgtcggataagttctgctgcgctccgccgggcggagcatttttgtaaacgttgtcatttttaagcgcaattgagggtcttctgtcgatggagcgttctctgctgtctggctgataatgatatgctccagcagcggcagcgagccgtgcaggctttcaaatacgggaattaataggtcgatgccggcgatcgctttgacatcgccgtttttcagcatgtatgcgatttctgaaggtgtgtatgccggattaacaggtatgacgacaattcccgcttttaacgcgccgaaaaacgcaataacaaaatcaggcgtatttccgagcagcagcgcgagatgatccccttttttcagtcccctgtcctccaagccgtttgcaaatgctttgattttacctgccagctcctcatacgtcatgtactgatcttgaaacagacaagctggtttttccggtttctgcgatgccgtttcttccaatttggaaaccagattcattttcccaccctttaaaaatataatgaatgaatagtcattcatttatccggaataaacgttcacttttattatagaaaaatatagaaaaacactcaagggcaaaaagccccgagtgccgtaaaaccggaaactataattgtttcagcgcttcactgaccggcgtgccgcccgctgtcagatcgaacgctttttcatacgtattcggttcatcaagggatgcgataacggtcttggcgacatcgtctcttgaaatggagcctctttctaaatcggctgcggctttgatatttcccgtgccgggatcatttaataacccgcccggccggataatcgtatacgtcagaccgctcgcttcaagaattttatccgcataatgctttgcggcataatacggcttcagcgcttcattccaattgtcgcggttatgagcctgaagggcgcttaccataatgaaccgcttgatgccggccttctttgccgcttctatcgctttcgccgctccgtcaagatcaatcagaagcgtcttatcgtatccggtgcttcctcctgatccggcggtaaacacaatcgcgtcacagccttcagcggctttcgcgatgtcttccgtgcttccttccaaatctgcaagaacggcttctgttcccgcggcttgaagcgcttctttctgctcttctttccggaccatcgcccgcagcgtatgcgtgccgtctttttgaaacagcccggtcagacgctgtccgatctgcccgtttgctccgatgagaaatactttcatcatgatccctccccattcattatggttctatcatttcacaaaaacgggcgcagattcaaatcatgcgttcggcaaatgttctaataaatcagctcgaggaaatcttccagctctattttgccgaaatactgtttcagatcgattccggccagcgcctccctgatagcggttctgtcatactgttttccggtcagcgcctgttcgacttcactcacatctttcgcaccgaagaaatcaccgaaaattttgcagtcctgaatgattccttttttcacttcaagacgcagatcaatcgatccgaccggataacgtttcgaatgctgaaggttgaatgcgggcgaccttccgaaattccagtcccagttttgatagcgctcttcggaaatcttccggatcgctttccagtcttcatcggtcagtttatattccggcacttcggaaagatcatttgtattaaaaatatggtgaagcagatgttttttgaattcgtccgccgtcattttgtcatcaagaaactcgctgatgttggcgacacggcttctgattgacttaatgccttttgattcaattttgtcttttttcacttttaaggctgacacgacatgatcaatggcggaatccagcattaatgttccgtggctgaaaatacgccctttcgtcgaaaattgagcgttgccggaaatttttctgccgtccgcgacgatgtcgtttcggccgcttaattcagcttccacaccgagctggcgcagcgcctgaataacgggttcggtgaattttttaaaattgtggaagctgtcgccgtcatccttggtgataaaactgaaattcagattcccgaggtcatggtaaaccgcgccgcctcctgacagcctgcggacgacgatgattccgttatcttctacgtatttcgtattgatttcttctattgtgttttggttcttcccgatgataatcgacggctgattgacataaaacagcaggtatgtctgttcagggtcgagatgcttcacgcaatattcctcgattgcgaggttgatcctcgggtcggttatgttttggttgtcgataaataacatggtgctcctcctttatttctcccacttcaatccggaagcggcgattgtcacttcgcccccgaacacggattccgcttcttctttcagcttccggtgctcgccgaaatgaggcagatgtgtgagaatcagctcccccgctccggcctcctccgcgatacgtccggcttccaaactgttcatatggccggctgacgtgccgtcctggtccgcgtaaaaattgcactcgcagatcagcagatcggcattttccgcaaacgggataaacgcgtcctggtagcttgaatcagccgtatacacaacagaagctgaaccgtcagtaatccgcatcgcataacaagtgaccggatgcaccgttttcaggaaggtaatggtgaacggcccggcagaaagcgggcggtccggctgataggccactcctttcgtatgcgttttatatgtaagacgctcaaactgttctatatcagcatcatgcccgtaaatcggcagtgcatgcgtcccttttccgagaaaggagccgacctgtttggcaaattgaagcggcccgatatcagcgatgtgatcatggtgataatgggacaaaatgacggcatcaagctcttctgccggaacataggcaaacagctttgataatacggcgcttccgcaatcgacgagcagagaatagccgccggactgaaacagatagcctgaagttgcttcgtttgcggccggaaacccgccgcagcatccaataactgtaactttcatatgaccctccgaatgtttatgataaaaagatcctttcctccaatatacctatttttcgtacaaattgcatgttttaaacattgtgccaaaacagccgttgattttccaaaactgttataatacaatgtagagacaaaacaatgaaagagggatgggtatgttggaaaagatgtcggattttttcagaaatttacccggtaagaaatgcgaagaatgcggaaatgagattgttgagcagtatgagtgtcacattaatctgtgcaatgactgcttgaaaattaaggatatgtgacaatagggcgccgcacaattctaagttgtgcggcgcccgttttttcggccgtcatcatactttctgaatagggcgttattcaccattattagcaattatctgtacgttttaaaagattcagtattttcaatctatatttttctatagacggattgttttcttttctattataatttgttctaatagctatctttttagatacttattgcacttttttcttcgggaggtaatctatgaaaaaattacgctttggactagcgacgcaaattttcgtcggactcatactaggggttgtagtcggtgtcatctggtacggcaatcccgccattccaacatatttacagcctatcggcgatttgtttttacgcttaatcaaaatgatagtgattccaattgtcgtctccagcttaatcatcggcgttgccggcgcgggaagcggaaaacaagtcggaaaattaggcttcaaaacgattttgtattttgagatcattaccacttttgccattattctcgggctggctttggcgaatctgtttcatccgggaacaggcgttaatatacatgaagctcaaaagacagatatcagtcaatatgttgaaacagaaaaagaacaaaataacaaatctatcgcagacacattcctgcatatcgtaccgacaaacttcttccaatcattagccgaaggagatctgcttgccatcatctgctttaccgtgctgtttgcactcggcatctcggcaatcggtgaaaaaggaaagcctgtcttggccttctttgaaggtgtttctcatgcgatgttccatgttgtgaacctcgtcatgaaagttgcgccgtttggtgtttttgcgttgattggtgttaccgtttccaaatttgggctcagttccctgctttcactcggtaaactggtcggtttagtgtatgtagctttggctttctttctcattgttgtattcggaatcgtcggaaagcttgccggagtaaacattttcaaattcctcgcctatatgaaggatgaaattttattagcgttcagtacgtcaagctccgaaaccgtactcccccgcgttatggaaaaaatggagaagatcggctgtccgaaaggtattgtttcctttgttgtgccgatcggatatacctttaacttagacggatctgtgctgtaccaatctatcgccgctttattcctcgctcaggtataccacattgacttgtccatttggcagcagattacccttgtgcttgtcttgatggtcacttccaaaggaatggctgccgtgcccgggacttctttcgtcgtcctgcttgcgacattaggcgcattcaacattcctgcagaaggccttgcattcatcgccggtgttgaccggattatggacatggcccgcacggtcgtcaatctgaccggaaacgcgctggcatccgttgtgatgtcaaaatgggaaggccagtatgatcccgttaaaggcgcgaaggtcatgagcctcgccaaaacagaacaaaacacaaccatttcaggttaaaatgaaaaccctgcacggaatgatttccgcgcagggttttttatgccatcggcgatagaacgtaccggtgcaaaagcttcgccgtattaagaagcgataattcatgcgtgcgttcaaaagcgtgtgaagcgtcaattcccgggccgatcagcccgtgaacgatgtcatggcccgaacggatggctgctgaggcatcagaaccgtaatacggataaatatcaagctgataatcaatgccatagcgctccgcaagcccggccagatgttttctgagctgataatggtacggtccgctcgcatccttcacgcaaatggagacggtatattcatccgtagactggccgtcgccgatcgctcccatatcaacagccaagtattcgacggtctcaggaggaatgttggaattgccgccgtagccgatttcttcattattagaaatcagaaaatgcgtcgtatacggaagttcgattttctcttccgtgatgcggcggattaaattcaagagcagagccacgctcgctttgtcatcaagatgccgggacttaataaagccgctcggcgtaatctgcacgcgcgggtcaaatgagatgaaatcgccgaccctgatgccgagatcggacgtctcttccttcgtccggacaggctcatcaaggcggacttccatattctcctgattccgctctgccttgccggcgtccttgtagacgtgcactgaagtctgatgcattaagatggtgcctgtataggttttgccggaagaagtttggatctcgcaatattccccttcaatcgagtgatatcggaagccgccgatcaagtcaatcttcagccggccgtccgactttatttcctttaccatcgcgccgagcgtatcgacatgcgccgtcagcaatctgtgtttcttgtcatcacggccgggaattgtgacaaaaagaccgcctttgcggtttctgtaagaggagacgccccattcttttaaaagactttctgtataggcgacaacctcgtatgtattgcccgtcggactcggaatcgacaccagttctttaatcagttccatcgtatgtttcatattttccacaggtcattcctcctatcaattttattcttcttaaaatatactcttttgatccataacccgtccaatcttttcctgctcttttttcatagaatgaagggagcatgagcataggagggaaatgtatgatcagccgtaaaccgcacaagcggaaaaggtttcataatgattggtttgaggattggtttgaggatgattggtctggtgcagccttctggtgctgtaaaaaagaaaaagatcactgtaaaaagaaaaaagaagacccttgtaaaaagaagaaagacaaaaagaagaaagacaaaaagaagcatcatcattcatgccgccgctgctgccgtcattggtaatcgttcacacaagcccgttttacaaataaaattctcatgctccccaaacagcggatgctgcttgggtttttttattaaaattagtaccaagtaataatatcaggtgttataatctgatataaaggagtgattttttcatgtcaaaatctaaaattacagcaatcggtacatatgctccggcacgccgattaacaaacgcggatttagagcgcatcgtcgatacatctgatgaatggatcgtccagcgcaccggtatgaaggaaagacgcattgccggcgaacatgaattcacatcggatttgtgtgtggaagcggtgaaaaaccttgcagaacgatacagcggaactcttgatgatgtcgatatgattcttgtcgccacaacgacggcggactatgcgtttccaagcaccgcggcacgcgtgcaggcttacttcggctggccgcacacgggagcgcttgatattaacgccacatgcgccggactcacttacggccttcagctcgcagacgcattaattaccgccggttcccatcaaaaagtgattgtcattgccggtgaaacattatcaaaggtaacggattatactgaccggacgacctgcgttcttttcggagatgctgcaggcgccctattggtggaacgcgacgaatcagcgccgggctttttggcagccgtgcaaggaacagcgggaggaagcgcggacgtgctgtatcgcacgggactgagcgcagaattaaacggcgagccgcttaaaggcggaggaaatatggtgcaaaacgggcgcgaagtatataaatgggcggccagaaccgtgcctgaggaatgcaatgcccttttagaaaaagccggcttttcaaaagacgatctggattggttcgttcctcacagcgccaacatgcggatgatcgaatccatctgtgaaaaactgcccttcccgcttgaacggacattgacaagcgttgaatattacggcaacacttcatcggtttctattattctcgctttggatgaagctgtgaaagcaaaaaaactgtcggaaggccagacgctggtattgttcggattcggcggcggattgacgtataccggacttttggtgagatggggattttaatcgaaatcaaaaaaaagaggccctgagcatctgctcagcgcctctttttcttatgctgttatttcttcttccgttttgtgttcttttttgctttgcaccgtaaaatacacgatggtcagcgcgatcatgacaacggcgatgcccaacagaatggatgcctgctgccacatatagccgtaatcgccatttgaaatgacggcacggaacccgttgatgctgtaagtcatcggcagtgccccgtgaatcacttgatagaatcccggcaggagttcaagcgggaaggttcctccgcttgccccaagctggagcaccagaatgatgacagcgataaagcgtcccggatttcccatcgttgtcgccaataattgaatcatcgacaggaacgcgatgctggtaatcatcgtaaagagatagaatctccaagtgctttccacatcaagcccgattccttttaacagaaccgtggcgactataacggattgaatcagtccgacgagcagaatgacgctgaatttgctgaggaaccattcaaaaccgtttctcggacgccctgaagcttcactcagagggaatacgaccgtcagcatcaatccgccgacatacaagcccatagagagaatataaggcgtcagtccggtaccgtagttaggcacggaatgaatcgcgttatcgtccgtttttaccggatcggcaaacatgctgtacgttttgtcatctgtcttaatgtccccggtttgatcagccgcatctttcagctggctggacaattgtccggtgccgtctaaaagcttgcttaaaccggtgccgagagacgcttgaccctgctcaattttggacgagccgtcatggattttgttttgcgcgtccagcagtttcgttaagccgccagacacctggccgctccctgacactaacgcttctgatcctgatttgagctgtccgaacttgctgttgtattcgccgataccggccgtcaatttgttttggctttcaaagacggtctgcgctccgctgtacaatttatcagttccagccgtcagctggttaatcgcgtcttgtaccgccgccgcgccgttatacagtttcgatgtggactgaggcagtgctttcagctgatcagccttcgcttttacatctgccagcgcgctttttatgactgacatatccggaagctggatatctccgccggacggaagctggctgacgatattgtctaaatccggaaggtcggccttcggaagcttctcattcagaagctgaacaagtttcgctttttgctcatccgttaagaaatcactgtccttaatcacctttttgaccgcgtcatcccgggcatccaggctgtttttcagatcagaaagctttttcttaaactgctgcaattccttttcagtctgctcaagctccccaaccgctttttcaatatctgagaggttgactgaattgatcgcatcttcaaatgccgccgctttttgcgacacttcctgcgccttgctgtttaacgcgcttaatccattcgttaaatccggaagcttttgctggagctgcttttgtgcgtcaaggctcgttttcagcccgctggccacttggcctcctcctgaagcaatctgccctgatttatcttgaatttcggcgcttgcgctctgaagttttgcgatagagctgtcaagcgtttgaattccgcttgtcactttcgccgctccgtctgcaagctgctgcgttttatcgccgatggtggcggtgctttcagtaagcttcgctaaattttccttcagcttggcgctgccgtctttcgcgtttttcgtgccgtcgtctattttcttggcgccgctgctggctttgccgagtcctttggcaatatctttaaaattgtcaaaaatgacttttgcgtattgctccgtcacttctttcgacacggaggctttcagcttgtcgatcgccttttcgccgattgtcgcgccgacatagtttgatccggcattcgtatgatatttcagatccagcttcttcggatttttatccattaccgtgctggcgtttttagaaaaatcttcaggaatctcgaccaataaataatatttagcatttaataagtcctttaacgattgatcaagatcgtttgaaaaatgccaatcaaaattatcatttttctttaactctttcacaagatcgtcaccgatctgaagatgtttcccttcgtagtccgcccctttatcctggttgacaacgacaaccggcagctgatccaccgtgccgtacgggtcccagtacgccttcaaaaacactccgctgtagatcagcggaacgaataatatggcaatgatggggattaacagtttcttgttcgttacaatgtctttccactggctttttattgtattcaaccctgttgcctccttccgcaaactgactcatttgacaaaacggtcacggcacctaaaaagtgaaggatcatctattatttagataatccttgaccaacatacatttccagcaattcggcgatcgtctctttttcaagaggcggatggtttttttcccagtcaaatatcagcgcgatgtagagcttgagcatcacaaaagcggtcagttccggatcacacggtttaatgcttccgttttcaatggctgtttctatcttttctttaatgtatgacagaatggcccgctccattttcgcaatgacatcctgaacggctattgtaccaatctcggcgttctcctgaaaaattttaatagtcagctggtgtgtttttctgaattccaaaatcgcgacaagcgcccggtgaacattttcgtgaaatgaaagctccggtttcatcgcttcgtctgcgtgttccttcatttctcttaaaatagtggtgaaaatatcatcaaacagttcttctttgtttttgaaaaacgtgtagatggttcccttccccacatttgcaagctttgccaccagatccattgtcgttgctttgtagccgaattgtgtaaaagacttcgttgccgcttccagaatgagctttttccgatcgacggacatgtttcccacctcgttaaattgaccgtttgaacgttttagtcattttgtacataagataacttatcacagtcgcaaagaagattcaaatgttttttctctttattggtgttccctttacagaacgggaacatgcaaaaaacctccgttttacgataacggaggctggtacgtttcaaataaataagcgagtgaatcatatacggcggcttttccctggtcgatacagtcggggatgcccaccccttcgaaagacgcgcccgtcgcgtatacgcccggataggaagctttcagcgcatctctgaactctttgatgcgctccttatggccgacatggtattgcggcatgctttcgttccagcgggtcacacaggtcatttccggttcgccatttattttcattacttttttcaaatcttccattacgattttaatgatctcgttatctgaaagatctacgatggattcatctccggcctttccgacgtacgccctgagaagtgttttgccctccggcgccgcgtgcggccattttttattcgtccatgtgcaggccgtgatggagaaatcgctgtttcttgagataacgaatcccgtaccttcatgctccattttgacggctccctcaggaaaacctaaggcgacgttggcaacggacgtagaatgcatatctttgagacatgaaaccgccggcagatcagaaagcattttcgccgcggctttatgcggggctgtcactatgcatccttccgcatagagcactttgccattatcaagcgtcacggaatatcctttctcctcgcggccgatatgggtgactttcgttcctttcatcacctttgtcagcgtaagctgcttttccagctcctccaccaacgtttgaagtcctgtcgtcaccgttaaaaactggccctgctttttggccgtcagctgctgtcccgaaggctgcggacgtgattttttcataccgagaatcaggcttctgtgcttttgctcagtctgatagaattgcggaaacgtggacatgaggctcagcttatcaatatctccggcataaatccctgataatagcggttctattaaattctcaacgacttcgtcaccgacgcgtctgcggaaaaattcacccagagactgatcttccttcggtttgctcgcaggcaggacaaagtcaagcgccgcccgcgcttttccgggtacagaaaataaaccggtggagatgaacggagcgattttggtcggaatgcccatcaccgcgcccttcggcatcggatgaagcgtctcattgacgagcacgtaagactggccggtcgcattgttgacgagcagatgctcaagccccaaatccttaacgagctgcggcgcgctttttttcctttctaaaaaagaatccggcccccgctcaatgatgtagccgtctttatgcgccgtctgaattttgccgcccgctctcgggcccgcttcgatcagggtgacctcaagcggcagctgtttttccttgatttctttttccatgtagaaggcggcggctagtcccgttatgccgccgccgatgatgaccagatgttttttatcgccactcatttttatcgccttctttaccgtttaattctacttgtccagctctttcagcacgaccgctgcaagcgcgtcgataaattcaggctgtgcgttcggcatggccggacgatagtagcttgcgccgacttcttcggtcacagctttgcattcataatcattatcgtaaagcacctctaaatgatcggcaacgaagcctgcgggcacgtatacaaatgctttataaggatgcttttgatacagctcgcgcgtgagatcctgcacatccggcccgagccacggatcaggggtgttcccttcgctttgccagccgactgcgtaatcggtaattccggcgccttcggcaatcagttttgcggattcctccagctggtcaggatacggatcgccgtattctttaattttttcaggaaggctgtgcgctgagacgatcagcatcgcgtcatcccgttcttctttcggcattgattcatacgttttcttcacctggccgacccaataatcaacgaatttcggttcatcataccagctttcaacagacttgatggtcaagccgccgagcttctccgcttcttctttcgcgcgtttgttgtatgactggacgctgaatgttgaaaaatgaggggcgagcacaaggctgacagcttctgtaaggccgtctttatgcatgtccgccaccgcgtcttcaataaacggttcaatatgttttaatccgatgtacactttgaatgttacgtcgtcctggatttcatttaaacgctgtgcgagcttctccgcctgctcctgcgtgatttttgccagcggagaaatgcctccgatcgcttcatatctgtcttttaagtcttgaagcatgtgcggctccggctttcttccgcgtctgatatgtgtataataacgttctatgtcttcttctttgtaaggcgttccgtaagccatgacgagaagtcccattttctttttgctgctcattttgttaaacacctcttttgatggtctgtctaccttgattttgacaggaaaatcttcttataaccaacgatctgctcaggaagattgttccgtttttttggccgcggaatattcatgtacaaacgccgtcagctttttcagcgttgccggattgacatcagggaatacgccgtgccctaaattgaaaataaacccgtccgttttcatgccttgatcaagtatcgctttcgcttttttctcgatgacttcccaaggcgcaagaagaagcgacggatcaagattgccctgaaccgtttttgtaatgccttgttttctggcgtcatctatgccgagtctccaatcaagaccgacgacatcaagaggaaggtcatgccaatccccggccaggtggcttgcgcctacgccgaacatgatcagcggaacttgctctgctgaaagctcccggaatattctgtccatcaccggttttataaactgccggtaatcttcgcggttcagcgcgccgacccatgaatcaaaaatctgaatggcttttgcgccggcattaatctgcgcttttacataaacgataatcatgtccgcgagcttgtccatcagcatttgccacgcttgcggcatactgtgcataaacgcttttgttttgttgtaatttttagaaggcccgccttcaatcatataactggccagcgtaaaaggcgctcccgaaaaaccgatgagcggaacattcagctgttcgtttacgagtaatcggatcgtttccagcacgtaaggaacatcctgttcgggattcagttcgccgagcttttcaatatccgcagcagagcgcaccggctgatcgatcaccgggccgattccgttttttatttcaacatccactccgatataaggaagaggcgtcataatatctttatataaaatggcagcgtccactccgtactgctcgaccgggagcctcgtcacatacgcgcacagctcgggctgatgcgtaatttcgactaagccgtacttttctttcagcttgcggtattccggctgagacctccccgcctgtctcatgtaccagacagggacgtgatttgttttttctccccgtgccgcttttaaaaacgtatcattaaacgcttctcgtttactcatctgaatttccacctttcctcctgcaaccatacgttcgtgttcttcgcccattacactataccttgttttttctgaatggtatagaattgaggcttaatgttcaaaaaatcgccgaattcatgattaagaagaaaaaagcttcggctgaacgtattccgttccctctccttcttgattcgtctgcgaattaaatggaacgactttgtatgaagcccctgaaaacagattggcgtacggtatgtcaaagctgccttttcctttcaccgaatccagaagcttgtcttttccgtctttcttctcatatattcggtaaacaacccgatcatccttttgaatatcccattttaattgaaccgtaatcagtcccatcgccttaaatgtataacgggccgacagggattttaccgcctccagctcaatcgggctgcccagttccttcacattttcaggctttttgaatgtccggccgttttcccccgcttttgtgacgatatctttaaagagtctgaccgggtattggctgccgcctttcagataatgggttttatccgttttgtcatagcccatccagacggctcctgtcagtccgggagtgtatcccgcaaaccaggcgtcctttgtcgcgccggggatgccggtaaatgtggtcgtgccggttttccccgccaggtcaccttgatagctgccttgtgaagcggttccttcttttacgacctgctgaagcattctcgtcatattccatgccgtctgtccgctgaagacgcgcgttttgccgtttttaggcccggataacgtttctccgtcttcgtccgtgatgttctctataaaaaatggcttcgtatacattccgtttgccgcaaaggtatgataagctccggcaagctgaagcggagtgacgccttcagacagaccgcccagcgcaatcgcgagtccgttgtcagaaatgttcatgccgtttttctcaagatacgattttcccatatccacgccgatctgcttcaatgtccagacagcgggcgcatttatgctgtaagtgatcgcatcctgcatcgtcacttcccccttgtactgtccgtcataatttttcggttcatacccgtcgtaggacgtcagtttgtcttggagaagcgaatacggtttgaacttgtcttcctgcatggcgggcccgtatacggcaatcggcttaaacgttgagcccggctgccgcttcgccgtaaccctgttgtatccttttgtcacgtagtcgcgcccgccgaccgccgcgcgcacgcctccggttttattatcaataaagacggcgcttccctctgccgcctgatccgtccccggaaaatagccgctttccttcatgagggtatatgccgttttctgcagcttggaatcaagtgacgtccggatcgtataaccgccttgaagcagctgttctcctgacatcgaataacggtcttccgcctccttgatgacaagatcgatataactgtcaaaccaaggcgtttctgatgttttcttgacattaagccccaatgtccggccctgggctctgacggcttccttggcgctgatatagccttgatcgttcatcattgcaagaatcgtatcgcgccgttctttatttttatccggatgctgaatcggcgaataaagagatggcgccttcggaatcgctgccagaacggctccttctgcaacggttaaatcttttacttctttattaaagtagtagtgggacgcggcttgaatgccgtaaacgccatggccgaaataaagctggttcaggtacatttcaagcagcttgtccttgctgtaatcacgctcaagattgatggcgataatgacttccttcgtcttgcgcaaaaatgttttatcatgagtcagaaaaatgtttttcgccagctgctgggtgatcgtgcttccgccctccaccttgccgcctgctaaaacatcccggaacaccgcccgtccgacagacttcacatcaatgccgtgatgttcgtaaaaccgtttatcttcaacggcgataaaggcatctctcacatcttccggaacctgctgaatggataccggctcacgattttccgtatagaggctcgcgatttcatcaccgttttgatcgacgatttttgaagatgcgtgcagtattaatttcttttcatcgatgacataatggccgagaaatataatgataatgtatccgattaacgcgagaaaagcggttgccgccgcaattacagccggaataaagaatctttttttctttttcagcataagtcacctcgcctttcttaacttgtagtatgggaaatattgtttcgaattatgtcagaatgagtcgccaatagaaacttataccactcttttgatatactagcaagcaggaggtggctgatatgaaggtttatattacatacgggacagccgattttttaaagacgattgccaagaaacacccgagtgagaatatggtgctgatgcaaggggaggataatgcggttttaattcatgaaacaaatggagaaaccgtttttcaggcgccccattcctatgaaagcatcgacagcgtcggggaaatcaaaaatccgggctacgccgtcctcaacaacatcgccgttacccaggaaggccgtccgctgtttgaaaaccggtttaaaaaccgcgccggcaaagtggaaaatgaacccggttttaaagccatccgcgtattaagaccgctcgaaggcgatacgtatgtcattttgaccctgtgggaagaggaaaaagcctttcaggattggcagcagtcaaactcttatcaggaagctcataaaaaacgcggaacatctgccggtatcgacacgacgtctattttttcccgtccgtcttatgtaaccgcttattacgcaatagactgaaaaccgccggagattctccggcttttttgatgtcccgattttacgcatccttctttgcaccttccgcccgcctatgaataccctgtagcaatcctatttataaacggagtggttcaattggggatcggcgtctactcggtacatctgctttatgttgcttttatcgcggccattatcgtttttatgcttctcagaaaagatacaacctttatttcactcgccggcatttttgtgattgcgctatggacgacgcattcattctccgcttcggtcagcagcctgtttcacagctttacgtatgccgccggagaattgctgccgacgatttttatcatttgttttatcgtggcgatgagcggccttttgaccaaaaccggtattaatgaagcgatgatttctccgtttgcaaagctgatgaaagggccggctgtcgcgtattgggttatcggctgtctgatgtttgccatctctctttttttctggccgtcacccggggtggcgctgatcggcgctgtgctgcttcccgcagcgatccgggcgggcctttctccgatcgctgcggctatggcgatgaacctgttcggccacggattcgctttatcgggggattacgtcattcaggcggccccgaaattaacggccgatgccgcgggcatcccagtgagcgatgtcatgcaggcaagtattccgctcgttttgatcatggggttaacgacgacaatcaccgctttcttcctcatcatgcgggatcgaaaaaaaacgaaggccccctctccttggacagctccggttctttggacacaagtatgtatctgccgaaaaaactcagggtgatcctggcggttttcattccgcttgtttttctcgccgatattatctgcatgatcgtataccgcctccaaggaaacgatgcgacggcactcgtcggaggaaccgcgatcggcattctcctgatcattcatttcattgtatataaagagcggcatttagaaaagatcaccgagtattttatcggcggttttcaattcggctttaaagtattcggccccgtcattccgatcgcggccttcttttatctcggtgacgcggggtttaaaaatattttgaacaccccgctgccgaaagggtctgcgggaatcgtcaatgacctcggactggccctgtcccattcttttccgatgtccggagaattcgccggcatcgccctggccgcagtcggtgcgattaccgggctcgacgggtcagggttttccggtatatctcttgcaggctcgatggcaaagctgttttctgccgcgcttcatacggacccggccgttttaacggcgctgggccagatttcagcgatctgggtcgggggcggaacattggtcccttgggcactgattcccgctgcggctatttgtaaagttgacccgtttgagcttgccaggaaaaactttatccctgttgcggccggacttatcgtcacgaccatcgccgccatcatcattctcccgtagcaaaaagattgaaatcttctgacattttctatacaatcatgggaaaagcagacgagggggcatcgcttttgacgttaacgacacttcaaaaaagcttaaacgctcagcttgacgggctgtatgaggaaatggttgaaatcaggcgtcaccttcacatgaatcccgagccatcctttaaggagaaaaaaacaccggcgttcatcgcctcattttatgaaaagctcggcgtccccatccggacgaatgtcgggggcaacggtgtcacagcctgtattgaaggcggtgaaccgggaccggtcgtggcactcagagctgattttgacgctttgccgatacaggatgaaaaagatgtgccctatgcttcacaaattcccggcgtcatgcacgcctgcgggcatgacggccatacggcggctctgctcgcggccggaaaagtgctgtaccgcaaccgggaaaaactgaaagggtcatttgtgatgatccaccagcacgctgaggaattatctcccggcggagcaaaagcaatgattgaggacggctgcctcgaacatgtcgatgccattttcggcacacacctatgggcgactgaacccgtcggaacggtcttatgccgcccgggcccagtaatggccgccgctgacggctttacgattaaagtcatcggcaaaggcggtcacggtgcgatccctcacgatacgaaggacgccgttttaatcggctcacaaatcgtcacggctcttcagcatatcgtcagccggcgggtaaatccggtgcagccggccgtcatctcagcaggctcgttcaccgctgaaaatccgtttaatgcgattgccgatcaggcagtcatttcaggcaccgtccgctcgtttgacgaaagtgtgcgcggcctgctcgaagcagaaatagaagccgtcgtaaaaggaatctgttccatgcactccgcttcctatgaatatcgtttcaaacgcggctatcccgccgtcgtcaatcatcctgaggaagcggcgcacgcggcggcagccgcagcggaaacagacggcgttacgaaagtcgttgaaggagagccgcagatggcgggagaggatttttcctattatctgcagcatacaaaaggcgcttttttctttacgggcgccgctttagaaaatgcggaaaccgtttatcctcatcaccacccgaaatttgattttaatgaaaaagcgatgctgacggccgccaaggtgcttatcggcgccgcggtaagctacccccgctgacataaaaaaaacagccggtacattacgtaccggctgttgtaattcttaaatgaaaaacgtgccttgccgtctcaccgagctgtgacagcagtttataattggccgctccgcccacggcggctccgacgaccggcaaaagctgaaacaatttgaccacgtccagataatcgcggtattcctgctgaaaaactctccaatcgacatcatgctttttcgaatcccactgttcaatcattgagtatatgcgtttccgctgttcaccgcttgagaaagccagctgaaaaataaacagcaaaaacaatcgctcatccctgtctttcacatcatagccgtaaatggaggcaagatcgaacagacatttcattttaatggatagcagcaaaggaaaatcagccattcctaaaaaaattccgccggcccccgtaccgataccttcagctgccgcgaccttttggtacgatgcgatggtttgtctggcgagagcatctttttcagcaagcgtcataccgtttgtatcccgcttgcttttcaccagatttgaacccgccattgttgcttcggtcatttttttaatgctttctgtgatgacggcatgaattttttcgggaatccgctcatttattttcgcctgcattcctttagaaaagcgttcaagcatggaatctttgcgcaaaaaacgcgctttccattgcagtgcttcctgtaccagctgctgatcgtcggtcatctgtgtctccttctttcattgaggtttcaaaaacccgattgattacagcttgccgtactttttcaatcttccgcccatatacgatggcatgatcacaaaaatcagaacggctgaagcaacggccgcatacagcaccccgctgactcccgcggcataggctgacgctgcgcagaacagcagcgcctgcacggttaatgacgatttcatcagcgaaaagaaactttgcagcttcgctttctgattgaccgggtaaagctcctgcagagaaagatgatgaaaatgcccgaacagcggaagaagctgtattcccgtaataaagacggtaaatacggttaacgccgccgtgatccacggattggcggaaacgagcataataatcaggataaaaataatcgtgagcctgacctgaatgccgagataatcatttgaacgcagaaaggcccgcgcatacatataggagaacgttttccgctgctcaaacggaatcattctgagcaaaaagtcgagatacgcccggcgttttgcctgttttttcaggtgaggcacatcggtaaacagattggcgattctgtaaaaccgctgcttccttcttaattcatattcaatatgagcttcccattttaatgatttatgttttgcggctgatgtgaaatacacataaaggccggccatcacaatgtagacggcggcagcgtacacataaaacgactgtaagacgaagtataaaagcagcatattgcagataaagcgtatgaccgcatccatcattttcatgcttctgtcattcataaacgtcatccgccactccatggcctgattccacgcttttaccgccagcatctgaataaatacggcggcatacgacgcaagcgacgcccccggacttacagcgaaaaacagaggcatgcatacaagagacagagcaataagcggaaacagctgtgacagatagctgtacttaaatgaatgcttaaagtatgtccccattttcggttcaagcggcagcagaaacacgaggtccgcttcctttaacagcgtccggacgtatgaaccggtcagcacaaatgaaaagagcaccgccatcacccaaaaagagggaaaatgaacggggatgtctttgacccacttgctgtaccagctcgccgcgccggcaataaaaaagatcagcacaatgacgagatgatcattgagcatatatttcatatacattctggtttcctttatatgctcttcaagccgggactgccaaatagtagacatattattcatggccggcgtcttccttcgtcagttcaatatacaagtcatcaagagctgcgtctttcatgccgaactgctctctcagttcttccagtgtgccgcttgcccgcacttcgccgttatgtaaaataatgaatgcgtcacagtagcgctctgccgtagccaggatatgcgttgacatcagcacgcttgatccggcttttttcgcggcgtccatccgctccagcaatgcattgatcgcaagcgggtcaaggccgagaaacggctcgtcaatgatataaagcgagggctccgcgagaaacgcgcacatgatcatgaccttctgcttcatccctttggaaaagtgagcgggaaaccatttcagccttttttccattctgaattctttcaaaagcggaggaagccttttttcaagcgtttctttggaaaggccgtacgccatggccgtcagctccagatgctctttgagcgtcagttcttcatacagcaccggcgtttcggggatgtacgtaaattgcgagcggtagctttccttatcctccgaaaacgtcttgccgttcagctcgatcgagcctttatgcgggtccattaatccgataatatgccggatcgtcgtgcttttgcccgcgccgtttaatccgatgagtccgacaatctggttcggctcaagggtgaatgaaacattttttaagaccgggtttctcgtataaccgccggttaagtcttttaccgatagcagagacataatttctccccttctgattcgtttttcttcatagtaccaaaaataaagtctgatttgaaacgattccctttttttctcacgtgaaaagcgtgcatagttatcgttttggcggacatcataatgtatgtagaaggaaacagctttaatcaactgaaaatgaggtgtttataaaagacgtcttagaacagttggatgaaaatcaacatgtcctgtgcttacaatttcttcacacactgctttgatgatgttcttcattcatgatgaaataatcaaatgaggtgtttgtcccaggaatgattaagcagacccataagtcttcattttaaaaacaaatgaggtgcttacaaaaggcatatttaattttctgtgataaagctcgtacttctgcatcagggtgaacgcgcagccgttcatcctgttttttgttttgaccgtttttgtggtacgatgagaatatacatatatttcttttcagggaggaaacccatctatgcacaaagcggacgattgtattttctgcaaaatcattgccggtgacattccgtcttcaaaagtatacgaaaatgaacatgttgtggcgtttcttgatatcagccaagtcacaaaaggccatacgctcgtgattccgaaaacacatatcgaaaacgtgtacgagtttacgcctgagctttctaaagaatatttcgaagcggtgccgaaagtcgcacgcgccatccgcgatgaattcgagccgatcgggctgaatattctcaataataacggtgaaaaagcgggccaatcggtgttccattttcacatgcatatcattccgcgttacggaaaaggcgacggtttcggggctgtctggaagacccacgccgaagactatacgcctgacgatcttcaggagatcgcttcaaccgtcagaaaacggcttgcctcatcttaaagatgaggtttttttgcgtccggcaacacaaaaaacataaaattatattttttcatatcaaaaaaatcaaaaaattgtgataggataattgtattatttcttacactaaagcggaaaacagggagagatcgtaaacatggaacgtacaacgaatttcaatgcaggacccgcagcccttccactggatgtgctgcaaaaagcacagaaagaatttgtcaacttcaatgacaccggcatgtccgtcatggagctgtcccaccgaagcaaagaatatgatgcggtgcatcaaaaagcaaaaagccttctgaaagaactgatggatattcccgacgattatgatattttatttcttcaaggcggcgcaagccttcaattctccatgctgccgatgaactttttaacgccggagcaaacggctcacttcatcgtaacgggcgcatggtctgaaaaagcactcgccgaggcgaaactgttcggaaacacatccgtcacggcaacaagcgcagattcaaaccacaaccatataccggaagcggacctcacaggaatcaaagacggcgcctacctgcatcttacgtccaataacacgattttcggaacgcagtggaaagagttcccgaattcaccaatcccgctcgtagccgacatgtcaagcgacatcctgagcagaaaaattgatgtcaaaacgtttgatgtcatctatggcggcgcccagaaaaacctcggtccgtccggcgtcacggtcgtcatcatgaaaaaatcatggcttgaaaacgaaaacgccaacgtccctaaaattttgaaatactccactcatacaaaagccgattcactgtataatacgccgcctacatttgcgatttatatgctgagcctcgtccttgaatggctggctgaaaacggaggtgtcgaagcggctgaacggcgcaatcatgaaaaggccgacgtcctgtacggcacaatcgacgcaagcggcggtttttacgcggggcatgccgcaaaagacagccgttctcacatgaacgtcacgttcaccctccgcgacagcagtctcacgaaaaaattcgttgaagaagcgaaagcggctaaaatgaccggactcggaggccaccgctcagtcggaggatgcagggcgtctatctacaacgccgtcagcctggctgattgtgaaaaactggctcagtttatgaaaaagttccagcaggaaaacgaataaatttcttctaacataacggttcctttgatatactgtttgcatatcaatttttccggccatcgcaataaatgacgagcatattattggatggcgaaaaagcttagcagaggagagcttagtatgaaaacaaaagaattagtcattatggccctgtttgcggcaatcggagcggtgcttcattccattatgccgccggtattattcggaatgaaacccgatatgatgcttgtgatgatgtttatgggtattctgttatttccccgtgtgcagaacgtgctgatgatcgggattgtaacgggaatcatttccgcactcacgacatcttttccgggcggacagcttccgaatatcattgaaaaaccggtaacggcgtttctgtttctcgcgctggcgcttttggtgaaaaagagcgtgaaaacagcggccgccgccgtcattacaatagccggcaccttcatctccggtttgctctttctggcgctggcccttctgattgtcggcctgccgggggattcaccgccttggtgctcgcggtcgtccttccggcggctgcgctgaatgcgatcgccattatcattatgcatccgattgtgcagacgatcttaaaacggtccaatatgattgaaacggtgaaataaccgcataccgaaacctcttccggccggaagaggttttttaatgtgtttcagcatgttttatacgagaagttttgtgaaaaagataaggaacaatgcgagggcggttcctgctgagcagacgatggccttttggcggacgacccgcttcggcggataagaagcggcctggccgagcagtttcaggtaataaacggcgcccgccgcaaagacaagagccatacaagataaaacaatcataaagacagacaaccttctccctccttttcccttaaaaaatatgctaaaataaagcaagctatgtatagaagtttattcttctgaacaaaaatgataaaagttatgagaaaaaaaacggggtgattttaaatggctgacggacgttcccttttaacaggccttttcgtaggcggattgatcggaggcgcagcggtgttactttcggctccttcatccggaaaagagctgcggggcaaaatcaaagcgaattgcaattcaattgaggacacaatcaaacggttaaaaaaagacggaatggcgcttaaagaccagcttgtccaaacggcgaaagaaagcgcagaagtcattaaagacgtaggcggagagcttcagaccagcattaaaaggtggcaggaggaaatcaagccgcaccagcaggatcttcaaaaggaaatcgctgatattgaagagaaaatcagacagctggagaaaaccttacaaaactaatatcctatacaaccaaaaaaagtgcgggcatattgcgttccgcacttttttttgcggtttaaagcctttcacagcaacggattaagaatttattataaaattcttaaattttcatctttattaatctttattttattggcataatagaggaaaagaaaatgtgaagcaggtgatctgtattgaatcgtgttgaaccgccttacgatctaaaagaagctttaatctatacccaaaaaatggcgcagctgtccaaagcactctggaaatctatcgagaaagactggcagaattggctgaagccgtacgaccttaatattaatgagcatcatatattatggattgcctatcagcttaaaggagcttctatttcagaaatcgccaaattcggcgttatgcacgtatcaactgcatttaacttttcaaaaaagcttgaagaacggggatatctgaaattttccaagcggctgaatgataaacggaacacgtacattcagttaacagaagaaggggaaaatgtattcgaaagcctgcttgaggagtttgacccgtctagaaacgcggtgtttaaaggctcacagccgatctaccacttattcgggaagtttccggaagttgaagaattaacctgtgtcatccgccacatttacggcgaagattttatggagatattcgagaaatcattgacaaacataaacaatgattttgatagtgaagacggaaggctgaagaaaaaaacagacgaatcggctgtccatgaaacggctgaagagctggaaccgatcaacagttaatcaaagtgcttcattatctcaataaattcttccatcagcgctgtataaagcccctgctcatacagagcaaaaatcgtttcatgaacatctaatttttcgttcagctgtcccgcaaaaagcgcaaggagcttgtcaaacgtcacaaagccttgcgctttttgcgactccagctcgtcctccaattcgcggcagatccgcccgacctcttctccttcttcttcggtcagccctttttcaatcatcatcgcataaaaagggtacttatccatatccaccgttttcaccagcaattgtatgtaatattctaaacgcccgatacgctgatccattgaatccatccgtttcacttctttctatctttaatcttattttagctgataatgaatggagaagaaaggttaaaccgtacatttccatgtttcaccgagctcttctgttcttccctttccggggttattttttttctttaaaaaaggattgattttttctcctgaagagagtaaattattttgagattgtattccatctttgtacggaaggatgactctgatgaattgctggaaaaccattaatctgatcaaagattatggtgcggttcgtttattattgactgctgtaggttttatgatcctgttttttatatgcaacttcttggcattcgggctgctgcgtccgaatatcagtttaagtgacgggcacgtgtttgctttttgtgttctgctcgttgttactttatttgtacataaagtcatacatgtcctgccgatgatctgtaaaaaaagaaaaaaggaaatgaaaatgtacttcttgcggatgccgacatggaaaggcataccgaaaacgacgatgctgatttctacgatcagcccgtttttattcattacgccgctattgttttatgccggactggcatttccgagacacgctcattacttttatatgatttcgagcattcatgcgggttattgcctgcctgatcttctgtttgcgctgcacctggtcaaagcgcccaaatcatgtctgattgaccaggaatccgacggttttgatattttagtaaaaaaagtgccggagtcttgatatcccgctgatttttcaggttacattctatcttttttaataaatatttggtaatgtaatatgggagcagttcagagagagggggaatctcccatcattttattctattttatcgtggctgccctgtttattctttattttataaacaggctcacaaatacattatgccttgtcagagagattcctgaagaccggcaggataaggtattccgttttattaatgtatctattttaattttactgatctcttcattcgtcgagatctcctttactgtgtaaacaggcaaaaaaatatggctgacggaggtctgacccccgacagccatatttttttcttaataaagccaagaagcgccgatgatgatcaataagatgaacagaacaaccaataatgcaaaaccgcctgcaaatacttcacccatctccaaaagcacctcctacaaaacgttttatttttccaattacatcatatgcaatttacttctgaaacgattaggcgcccgggtaagaaaacggatcgcttttagaaaaagcgatccgtttcgcttaacaaatgtaagctgcacctacgatgataagcaatatgaacagtactacgagcagtgcgaaaccgtttgaatatcctccgcccatggttcattacctccttttcatgatcaatatatttgtatgtatcaggaaaaagtttgactagacgaatgccctttatttaaaatctttttacagaaagccacaatatgttatgatacgcatatgcaatttaatttggatgattaggagtgtttaaaggaatgaagaaaatcgcgatagcagctattacggcaacgagcgtcctggctctcagcgcttgcagcagcggcgacaacgacgtgattgccaagacggatgccggaaatgtaacaaaaggcgaactctacacgaatatgaaaaaaaccgcgggcgcaagtgtgctgacacagctcgtacaagaaaaagtattagcaaaaaaatacaaagtatcggataaagaaatcgataacaagctgaaagagtacaaaacgcagctcggcgatcagtacagcgcccttaaacagcagtacggcgaagattacctgaaagatcaggtgaagtacgaactgcttgcacaaaaagcggcgaaagacaacatcaaagtgactgacgctgatacgaaagaatattacgacggcttaaaaggtaaaatccgggcgagccacattcttgtcgctgacaaaaagacagctgacgaagtggagaaaaaactgaaaaaaggcgagaagtttgaaacgcttgcgaaagaatattcaactgacaactcaaaagacaacggcggcgaccttggctggttcgataaaaagtcaatggatgaaacattcagcaaagctgcattcggtctgaaagtcggacaagtcagcgatccggtcaaaacaaaattcggttatcatatcatcaaaaagacagaggaacgcggcaaatatgatgacatgaaaaaagagttgaaagaagaagttcttaaacagaaattaaacgacaactcagctgtacaggcggcaattcaaaaagtcatgaaaaaagctgacgtaaaagtggaagacaaagacttaaaagacacgtttaacacttcaacttcttctgaatctaaataaaaaaaactgtgcgggctctcagcgagccccgcacagtttttttatgcgatggaatgattggagttttcttctgcatccgtgttttcacttgcgggcgccgccatacggcgctcgcgttcctgttccatccgttcaatatacacccttccttctttttcaataaacgactggtcaagcttttcctcttctttagctgttgtgaaaagcttataggcgctgaaaataattccgataatgcaaaggtatacccaccaaggaaaaaatagcacgtcggtttcctccctttttcacccagagtctttattctaagctatgcttgataaagacaagttatgagagctgaacgtaaaaaagaccgatcatagagaatcggcctttttatcttattgatggaacgtcggtttgtagaaagaacggttttccagcgcaaatacacgctctgtgtattcgcccggcttcacccgttccagcgctctgtccatcatgatcatttttgcatccagattgtcaatgtagtgcagaatttccgcttctttcaccatcggcggtttcgggcttccccattccgcttttccgtgatggcttaaaatcaaatgcttcagaatcagcacttcttcagcgtcaatctgaagctcttcggctgcttttgaaagctctgtcaccatgatcgaaatgtgcccgagcagattcccttccacggtgtacgtcgtggagacggggcctgaaagctcttttactttgccgagatcatgcagaatgactccggcatacagtaaatcccggtcaagagacggatacagatcggcaatcgcttttgccaggttcagcatggacactacatgatacgcgagcccggagacgaactcatggtggtttttagccgccgccgggtaatccataaactcagccgcatattttttgaccagatgtcttgtgatccgctggatatttggatttttcatttcaaaaatgtattgagtgacggtttccatcatttcatttttcggaatcggcgccgtttccagaaaatcatcaatgctgacattttcgttctcgccggccggccggatgtttctcagcttaagctggtttcgtccgcgatagtgatggacatctccgatcaccttcacgatcgtctgcgccgcgtacgttacttcatcagtcggcttggcatcccacagcttcgcttcgatatctcccgattggtcctgcagcattaacgtcaggaatggttttccgttgcttgcgattcccttagtcgaagatttaatcagaaagtattgatcgacctgctcgccgacctcgtgcagcataataccttttgccattctattaaaagctccctccatatcttacataataccagtatagcacatacctcttttttgaaaataaactcttttatgacaggagccgcatgacttgtccgctgtgaaaagaccggctgacatgctcatggcaggtgaaataaagtatctgccgcccgccttctgaaagctgattcagcacatcaaacagccgctccagccgctgcctgtcaaaatggacaaaactgtcatcaagtaaaaacggaagtgataccgcagattccctctctgacgcaagggcaaaacggatcgccgcataaagctgctcgcatgccgcctgtgacagttcgcctgctgaaaacacagttccgtctttccgcatgaccataatggaatcatccgcctcggagaaatacaatttatggtaacgtccgtccgtaagcggtccgtataatgcaccggcggtttctaacagacggggaagcgtcacttttttatgccgctccattttttccctgatgatgtgtctgaccgtctgtaatgcggcccactctttagcggtttttttcacgcgctccttctgcatttctgtctgctgttttaaatcggatacaagccccgaggactccagctgctcttgtttcaccgttaataaagcggttttctcacggagctgcgcgcttttttcctcaagcgtttttttctctgtttccttctgaacgactgtatgttcaagttcggacactgtgcggctcatatacggctcaagctgttttccgcctatgccggacaagtgcgttttgatttcgcgcagctgccgctctgtttcccggcggctttcattcagtctggcgagttcacaaaagtgttcgcgattttttgcgcctgccgccatgaaaagctgtttgacctgctgttcgtagtaatggacttcttcgtttaattcacgcatttgctcttgtgcatgcagcagatccgtttcgagcgcctgctttcgttttgcttcctcacgggcccgttccgcctgtaccagcaaaacgcgcagtctttcttttacggacagctcccttccgtctgaaggactcagctttttgacccggtcctcaaatgctctttgcaacttttgcagccggcccgcttcaatggtcagctcatgcttattaaggatttcttttttgacatctttcatcacatgatatgcgtcaagaagatgggaaggacttcctgaaaaacccagttccttcataaaaagttccgcctgtttttcagacggcgccatttccgcctcccattcttcatattggcggatgactctttcatatgccgcttctttctgttcaagcacggcttgatccgcaatcagctgctgccggtgccggccgtcacgccaaagctcttcctgcagaaggtcagccgcttctttggagatcgtcggcttctttttcttgtgaccggcccctcctctttctgacggcagcggtttttgcatgccggacagcatatacagcagcagagcgccggtaaaaagggcggcgggcagccattcctttaacatagcgaaaatcgcaatgaacagaatgcccgcaccgagaaagagctttttttgtttggcgcgctgtttttccagctgctgtacatgtgcctgccattcgtttccttctgtatcagccgtttgcttatatgattgtaaagcggcttctttttctttcctgacagcggggtccaaaatgttttccgacgtcaaggcatgttttcgttcggcttcttccagctccagccgcgcttgttcgaaaatcgcatcaagctgtgtctttctttctcttgcctgtccggcgctctgcacggcttcctgcagccgccattcatattcataatcggtgttcagtgaaagaatgccgtcttcctcatgtcttccgagctgctgcaatcctgacaaaacgcgggcagatgtctgccggatctgtgattggatggcggcaagctgttcaccgcgcgattcgtacatatgctgctcgccggaaagctcctgcagctgccgctctgtttgcagcaagtcctcatttggagcgagcagctcagcctgccgcctgagttcagcagcttttgcccgaagtccctcaagacgggcagctttcggatggagatgcgattcgtatttttcaagctgatgcatcccgtccttcgggaattgcttcaatgcatccggataagaagaaagttcgctttccaaggctgtttttttgtctgcgagcggctttgcttctatcgccgattttactgttttgatttcttcagttatgtctttcaatcgtgcttcggcatcctgcaaacggccgccggcgctttttttctcttccagaaggctgtgatagcccgcttccgcagcttccgcctgtttcagctgggcgctgagccgctttaatgtatccaactcctgatttaagcgggggttccgcccgttcggcttatacatcctttcaagttcttttgccagccgcccgtcaagctttgccgccgcttccgacccgaataagctcgaatacaggagaaactcgccgattttgtcccggttaaaagcttgaatctcctgcagtccgaatacatcgaacgaatagatcgcttcgtacagcgcccggtctgtatcggagagaagctgtttgagccattctccgtccttgatttcgcctgaagccgtatacactctgactttttcggcagcgccttttgtccgttcgattttgacggcaccgtgatcgccatgcttcaattccacagtgccgccgtaaaccccgccgtttttcggttcgtatttttttgatttcggaaaaccgaacagcacgcttttgatgaaggacatcaatgttgttttacccgcttcatttaatccgtagatcacttgcacgggagaatctgacagctgaaaactttggtcggaaaattttccgtattggtaaatatgcattgccgttattttcatcgctgaagctccttcatctggcgtcttaaaacggcttgagcctgccgcttaatatccagtatctcttcatctgtaaatgaagtgatctgacgccgatatacgggatgacgctcaagggcttcaaatacaccgctcatgtccgcgcattgttctatgtcctgaagcagccctttaaaaaacggatcgggcggcacgctgtctgtttcatccgtccgatcctcaagcgcaagcggccagacgaaacattcctcttcggcctcttcctcctgtaaagcggaaagaaactcctctgcgatgcctgcgggcgcctccgtccaaaagcggggcgccgcgccgcgaagcaccagcctgacacatgccgggcggcccgccgcgcgcaagccggagaatgtatccgatgcggctttcagaagtgaagtcatatgttcagctcctgagatatcaagatcaatttcctcccataacacatcatgcgcttctttgaattcccaagacatctcaccgtttgccgcccggacgagataatatcccttaggcccggtttcttttaaatgccgggcttgaatattcccggggtaaatagcggcgggatgctgggcggacagaacctgccgtttatgaatgtgtccgagcgcccagtaatccatgccgcttttttcaaggtcttctttcgtaaacgggcagtacgggtcatgcccttccgctcctgataacatgccgtggagcatgccgatatgataaggcgcgccggtcattttccggtaacgggccgcctgattgaccgttacgcttctttcctgatagctgcatccgtatatgcttgccgcaagctctccgtttttaaagaaagatttttcctccggtgtacccgaggtgaatatatgtacattttccggccattcaatcggcgtccacttaccgcccaaatgatcatggttgccgaatatgacgaacacttggatacccgcttcctgtaatctcgtaaactgttttctcaaaaacagctgggcttttaaacttctgttggcttcgtcaaacagatcccccgaaagcagcacgaaatctgcctgctcccggagtgccccgtccgtcagacggcggacgctgtgaaatgtgctttctttaatacgcgcatataccggttcaggcagattcgaaatgccgtaaaacgggctgtccagatgcaggtcagcggcatgaataaacgtcagatcagccatctcgccctcccctttctgcagattgaattacccttattttagcaccgtttttatacgaatgcacgttctgtaaaataaaaaaacagcccggctgttccgggctgtttcatttattttttggagatgcgcagcgcttgtttgatcgctttgaatccgctggcgtttccgtaaatcaaaacgccgcctttgtaaattttcgcgccgaccgccgcaaagatcacgatagtgaccagtgtcagggcgatcccggccgcagcctgccaaaacgggatatcgagcatcccgacgcgtaaaaacataatcatcggcgtgaaaaacggaatgtaagatgtaacggtaataaaaccggcgtcaggattgccgatgccgaacatggcgatcataaaacctgccacgaccaaaaaaaccatcggctgaatcgtctgctgtacgtcctctatccggctgacaacactgccgagaaacgcggcaagcgtcgcgtaaagaaaatagccgagcaaatagaaaatgacggcatagactatcgtcgagacgggaacatccgtaaaattgaggaatgcactgatcggcgacgacgcatcattttgagggttcagcttcagtgagagataacccgctgcaatcagcaccgcaaactgtgtgatccccacgagcgcgataccgaacagtttggcaaacatctgctgaatcggcggcatgcttgaaattaaaatttccatgacgcgggacgatttttccgtcgccacttccatcgcaatcatgcttgcgtacatgataactgagaagtagatgacaaacagcatgatgtatacaagccccattacctgaccgagctcttcctcagatttcgcccctttttccagcgcgtctttgctgacttccggcggagtgtagaggctgctgactttttctgccgaaatgccgagcttggcggtttcgacagcggttttcgtctgggttaaagcctgcttgagcagtttatacgctgattcatcagaaatggtcagcgccttgtatgctcccgttatcgttcctttttgatcctgtctgatgataaacagtccgtcccattcaccgtctttgacacgctttacggcatctttttcggactccttcgtctccattgcctgcagatcattgtctgtatccgccgctttaagctgttttgcaaacgccgggtacagcccgcccgtttcatcaatcaccgcgatttgctgcttgccgtcatccgattgaaacacggaaataatcgattgcaggttggtcaccgctaatactaataaaacggtaatggcggtcgaaataatgaatgactttgttgcgattttgtttttatatgtatgaaacagcataatccaaaatttattcatatacggcccccaccttttctataaaaatatcatgcagtgacggctcttccaattcgaacttccgtataaaacctttcccttgcagcgcccggaaaatatcctgcgaaaccggttcattcgcgacctgcagtctgattccgtcatttgtttccttccatttcacgacaccttcatgcgtttttaaaaagctgaggtcatcatctgaatgaacggtgacattttttttgccgaaagaccgcttaatgtctttcagattgccttgaacgacgggttttcccttctggagaatgcacaaattctcgcaaagttcttccacatgctccattcggtggcttgaaaaaacgatggaaacgccgctgtttttcaaagaaataaccgcttctttcagcagctcgacattcaccggatcaagaccgctgaaaggttcatcgagaatcagcagttcaggcttatgcaggacggccgaaatgaactggattttctgctggtttccttttgacagctcttcgactttcttattcttgtaatctgtaatgccgaagcgttcgagccatgtcatgagctctttttccgcctcttttttgctcattccttttaatctcgccagatagacaagctggtcactcaccttcactttcggatacagcccccgttcttccgggagatagccgattttttcactgatggaataattgaccggcttccctttccaggtgatatgcccgtcagtcaggcttaaaagacctaaaatcatccgaaaggtcgtcgtttttcccgcgccgtttgcgccgagcagcccgaacatttccctttcaggtatttgcaggttcaaattgtcaacagcggtaaagctgccgaatgttttcgttacattttcaattgtaagcacgaatccaactccttccttgacccattatatactaataatgggtaaaaattaatggaggattttaaattctttatcagaatatcattctataaagggggtgacatgatgggacaatatgtattgaccgcattccatgcgtcgggagaaacgctgctggatgaacggatcgaagcagataatgaggcggaggcgaaggccgccggagaggctttgttagaggaaaaaaagcttgagaacagtactcaccgcttggtaaatgaagccggaaagctgattttattccacagataacagaagctttccggcttctgtattttaccggttaaattgcggcgtccgtttttctaaaaaggcgcggatgccctctttatgatcatccgtttttctcatattttcctgggcctttcgttcaagagataaaacgtcttttaaccggctgatatggaggctctgataaatagccttcgtttcaatcatcgctgacagcggcgcatgcagcaatcggtcgatatacggttgtgcccctccgcagggccgccgctgaacagcccgtcggcaagcttgagccgcaccgctttttcagccggcaatttttcaccgctccaaatcagttttttcgcttcgatctcaccgacgcgtctcattaataaataatggcctcctccgtcgggaaccaatccgatgccgatgaaattcatcgcgagtcgggcgttttcttcggcgagcaccacatcggcgcacagcgcgaaactcagcccgagccccgccgcggctccgtggatggcggctatcacaatttttttcatatcatagagcgtcagcgtaatggattcaatcattttcatgagccgttcatattctcccgaatcatgatccgacgtcatcatctggatatcaccgcccgcggaaaatccccggccttcccccgcaagaggacgataagcgcttcgctgtcggctgccataacgcatgcattttccaattcccggagcatttgttcattcagcgcgttgtaactgtcaggacggttcagcacaatctctgcgatctttcccttttcttcataacgaatatactgcatgtttactccctccttgaatccgcttacatattttgttcaaatgatatattccttcccccgaagcgaaactcctttatttttcaaggtcaacagataccgaaaaatgcatatcatttgaaactgaacatacatttttatatagtgaaattgatatacaaaacaaaaagggggaaaaacaccgataatgaaatatgtgatactcagcttgttactgagcttttttatggtgctgttcccccttcggatgtcgctcttccttcccaattggtgacagaaacagacagccatgtacaaatttcggtctacccgcaggaaacggaatcggcaaagacgccggttcaaaccaaaaccgctccgcaaggcctgtcaaaaggatacggtgcgttatcccggatgatctccctgttatctgtcaaacctcttgatcaattcattgattccacaatggaaaggacatgcgccattccgatacaataccagtcaaattacctccggcatcagaccatttctcattgccaatctgtatttacggtgtaaaaacagtatattccggagggattttttatgaatattaaagaaaacgatctgcccggcatcgggaaaaaattcgaaatcgaaacgagaaatcatgaaaaaatgacgatcatcattcatgatgacggcaggcgggaaatttacagatttgatgaccgcgaccctgatgagcttctggcaagcatttcacttgatgatgcggaagcaagacagattgccgcgattatcggcgggatggtgtacaaaccgcaggcgcttgaatcgattgaaatggcgttcagcgatctgattatcgaatggtttaaagttgaaaaaggggcaaaagcggcagggcggacgctcggcgaactggatgtgcgccaaaactatgacgtgacggttatcgccatcataaagcatgaccagaaaaagtttttaaacccgggggctgattcgctccttgaagcaaacgatacactcgtcctctcaggtgaaagaaagcatctgaaaaaactgatccaagacttcctctccagagacggagtgtgatctgtttatggaccatctcgtatttgaagtcggtacggcgttagttcttgtggccattgcgagtgtcatcgccaataaaattaaattctcgatcatccccttcctgatcattttaggaatgcttgtcgggccgcacgcgccccaggcgggcatcattgatctgacgtttatcgaaagccgggaagtgattgaatttttcggacggatgggcgtcctgttcctcctcttttacctcgggcttgaattctcagtcggaaaattagtcaaatccggacgttcaatcgccgccggcggaacgatttatattctgattaatttcagtttagggctgatctacggatttatcacgggcttttcctttttggaagtgcttgtattggcgggcgtcatcacgatatcatccagcgccattgtcgcaaaggtgcttgtcgacttaaagcgcacggccaatccggaaacggagctgattctcggcatcattatgtttgaggatatctttctggcggtttacttatccgtcgtttccgggcttgttctgggagacgcgacgtctgtcgggggcgcgctgatgtcaatcgtgatcgctttcggatatatgctgctgtttttcattgccgcccggaaattgccgcctctgctgaacaagctgcttgatatccgttcaaacgaggtatttgtcatcgtcattttcgccgcgctctttttcattgccggcttttccgaaacgattcatgtcgctgaagcgatcggcgcgctcttgctcgggctcgtgttttcggagacggcccattctgacaggattgagcatcttgtcgtgccgttccgtgactttttcggcgccatgtttttcttcagtttcggcctcagcattgatccgttttcactcggagatgcggtatggctcgccctcggcgccgttctgctgacgattgccggaaactttatcgccggcatgatcgccgggcgccgggcggggctttctcataaagcatcgtccaatatcgggctgaccattgtgtcccgcggcgaattctccattatcgtcgcaaatctcggcatcgccggcggcctgtccgcttcacttaaacctttcgccgccttatatgttttgatactggccatcttcggccctttgctcacgaaagaatcgaagcggatatatctcctgctgaacagcgtattcaaatggaagacgcctgaaaagaagccgcagaaatcataaaaaaaaactgacctcttcataagaggtcagtttttttgagcgggaagaaattgctgaaaagccgtttttttattaatggagaaatgctcttttcccagaatggtattgatgattttttggtttctgtaaacagacagcttcaaattcgtagcgcccgttccgtgagcatgatcaagattcgttaatgtgaaaaaatgatgccgtctgtcgtccttaaagacaagacgggaatcggccgtcactttaaaccgtttctcatcctcccattcgatatcgggggcgattgccgtaaaccattccggaatatgaggtttaaagccggtcgccaatatcactttttctgaatcggccgtaaaagtttcatccatctgccattgatgaaagctcagtacacagcgcccgttttgcttttcaattttttcaagctccgccatcggctgaatatacacgtcaggcgaacctccgctgatcgatctgtgatacagggcgtcgtaaatggtggcaagtgtgtcagaatcaatgccgtggcgcagtccgtccagctcagggagtgtgttcagccgttctttaaaaggcaggcggttaaaatattccacataatcaggtgtaaacatttcctgcccgagcttggcggtttccaattctcgaaatccggcggagcgtgtcacccattgcagccggctgcgccggtattgttcatcatgcaataagtcagaaaagatctccgcggcgctctgtccggagccgaccactgtaattgattcggcgccggcgagctcgtctttccggaacaaatattccgtgctgaccatcgtgtcctgacgcgctccgtcatcaatctctgcgggaataagcggttcagaccccgtccccatgacgaaatgcttcgtctgatagacactgatgcttccgtcctcaatgttcttgacgctgacttcataatgtccgccggcatttttcacgccgattacctctgagccgaaacggcatgatttgatttctgaagccgcccagcttaaatagtcgttaaattcccgtctcggaatatcaaattcattaaacgtataaaaccggtacagccggtcatgttcatggagaaagtttaaaaacgtgtagcggcttttcggatcggcgagcgtgaccaggtccgccagaaacgccacctgtaaatccgttcctttaattaatagaccgggatgccacgcaaattctttctttttatcgaaaaaaagagcgtctgttccgggtatatcctctaacaatgcggcaagccctaaattaaacggcccgattcccgctcctatgacatcatacatattatgcacctcttgcgaataacagtctgatgatcttttcccgtttttacagacggttaaacataaaaaaacggcacgctgattccgtgccgtttttgatattataatgcagatttgacgaacatctcatctaagtatttgattttctcttctgtataatgctcgaatcggtcattatatgatttcgggtctttcggattggcgaagtgcgtgatttttccggtttccggatgaatgaatttgcttgccgccccgcagccgataccgataatcgtctgcacttcttccataatcataatgttgtagatgctttcctgacccgggaaggagtagccgacattttcaaggtttccgagaatatttttctgccgatacaagtagtacggcgtatagccgtgctcttttgtccagcggacggcgtcatccatcatgcgggacacttcctgtctgtcggcaactttatacttatgcttgtttctcgtcatttctgacgcccgtttaaaagaaagcgtatgaacggtcaaagattcaggcatcagcttttccgtttcttcaagactgtgcctgaactcagccgtcccttctcccggcaggccgatgatcaggtccatgttgatattattcatgccgtgtttgcgggaaagatggtatttttcgatggtttcttcaacggtatggtgtctgccgatagccttaagcgtttcgttttcataagattgcgggttgatgctgattctgtcaatcttatacttatttaaaacggcaagcttttcctccgtaatcgtgtcgggacggcccgcttcaacggtaatctccctgatattcgcgacatccgggaaagagcggaccatttcttcatataaaagatccatttcttcagcggtaatgcttgtcggcgtgccgccgccgaaataaatggtcgtcactttgatatcatgccgcttcagccattctccgattttctgcatttcatagtgaagcccccataaaaaggagccgactcttcccgcctgtccttgaatggcataagccggaaacgtgcagtaggcgcacttcgtcgggcagaacgggatgccgatataaatgctgacttcatctttgacccggtacagatcgggaaccgcagcgagctggcggtcgacaatctcctgcatcagattgattttttcatcatggatcagatagtcttttttcagatcggcatgcgcctcttcttttgtcaggccgctctgcagctttttatgaagaagtttagtaggcctgatgccggttaagattccccatttttgtgtcatgcccgtatgtgattgaagaagatttaagtagacatatgacagcgtgtttttcacctgtttaaatacttctttttcgctccatccggcaagaagcggtttcgtgtgatgttccttttcgccggttcctttgatttctccggataccgacacgctgtctgcatcttgagaaatggcaagtgagatgacgagatcagagggttcctccgtttcgccgtacgtaagaacacactcttcaaaaaataaattcgcgatgttttgcagcggacgatgcagcctgtcatccgttatgccgtctatttttatttgcaatgtgatcaccttatttttcagattcaaaactttctttagtgtacagaaagaacaggctaaaatcaatccgcgaaaaagccgcagaccggcgtttcgcgtctgcggctcttgattacggccgtttcatatggaacttatcgagaaagcctttgcggtgctgcatgcggaaatattccttaatcatataagccactccctgttcatcatttgaccttgtcacccagtccgcttttctttttaattcatttgaagcattccccatcgcgacgccgagaccggccagctcgatcatcggcagatcatcttcctgatggccgatagccacaacctcttccattgaaagcccgagatcagcggcgaccatcgaaagtccgctttcttttgaaacccctttaggcacgatgttcagtttttctccgttgacgcggatcacatcgacggccgggaatgctttcattatcgtatccgttatatcagcctgcaggccatcttcagcatgcacttcaatgacgggcgctgaaaccggctcatcaaggagcaggtcacttaatgattcgacaaactgcaccggataaaagatcgggtcagacggatgaatcatcgttttcccgaccagattggagttcactttcttcttgttaccgatcgaatatttttcgtgaagaagccggatattgcattgatagctttcgagcacctgaacgatattaaacgtgtgatcttctgatattttcttttcaaaaaacggctcatctattttttcagaaatgtatgcgccgctgtgggtaatcaattttgcattcagctttaatattttcgccactttttgagcggagcgaaaatggcggtttgtgaccagtgtgacgtaaatcccttttttcttgacgtattcgatggcatcctttgtcgtctgatgaagtttgccgttggagcgaagaagcgctccgtctatatttaacgccagcatttgttttgacacagagaagtcccctccttgatgactgtacttgtcattaggatatgaccctgtctctttgtttagaacaaccttttctccgcagcaaaaaagcctgcctcaagcagactttgaactgtcgttttgttgggatacgatcgatttgctgccttctccccaatgtgcatttctattaacgaaatatatcaggaaccccttatttgaccgttgatgcgctcgtttcacttactctctgttgctaccccttaacataccaggcagtataggcgaccgtatccttagatcatctgtaagtgtaggcgctttcagagttattatctcaataatattgttaaaaaacaagggtttttttaactaaaaaaatcaggggaactatctgtgctgaatgtatgataaaattgaaaaggaacgtatattcgcatataataaaagaaaaaaagcggtgactgtcatgtctctattaaaagatatttataacgaagaatttgcagaagcacttctgcacagagtcaaatcggcgtatccggcttttgagcgggacaagtgccgggcgctgatatttcaggaagattggcccggactgacgttaaaacagcggatgcgccggatcacagactctttatatgaaacactgccgaaggattacatacgggcgcttgacgtcttatatgagacagctccccatttcacagggctcgccgggattatttttcccgattatgtccaacagtacggaacggatcactgggaagaatcaatgaaggcgcttcagtttttcactcgtttttccacttccgaatttgcggtccgcccgtatatcaggcttgaccgggagcggatgttcaaagagttcctttcctggacggagcatccggacgaacatgtcagaaggcttgccagcgagggctcaagaccgcgcctgccgtggggaatctccattccggctcttcttgaagatccttctccgattctccctgttctggaccgcttgatgcaggatgactcgttatatgtcagaaaaagcgtggcgaataacctgaatgacatctccaaaacccatccggatcttctggcacagaccgcagccgagcggttcggaagctgtccgcacacggattggattttgaagcacgcctgcaggacactgttaaaaagaggagacaaacaggcgcttgcgattttcgggtttgaagacgcctcccggatttcattggaacgttttacactgaattcggaaacggccgccatcggaacaagcatacatttttcttttcagatccgctcagccgcccggcaaaaagtcagggttgaatacgcgattgattttgtaaagaaaagggggcaccgcagccgcaaggtgtttaagatgtcggagtccgccatggataacggaaacgtaaaagccttcagcaaacgtcattcccttaaagatttaaccacccgcaagcattatcggggaattcacactctgtctgtcatcattaacggaacggtaaaaggttcgcttgatttttctgttgaataaaaaaacccctccatttcatagatggaggggtgtggagcttattgcgggctgccgtaaagctcttcaagaggtttcataatgattttgtttaactcgccgatcagcatgctcatgcgctgttccgcttccatcagctgagaaatcaattcatgctgctgtacgagagcaaccgttttttgtgcctgctctacctcttcctgagtgatttcttcacctgacatctgtttctgctgcagctgcatctgtacattgcggaagttatcaaacatgcgttttgcggattcatctgcgtttacttgatcataaagccctctcagacggctgtattcatcactgtttcgcaaagctttttcaagatcatatgctgcatcataaaaatgaactgccatagtaaccgctcctttcttcctttcggacataccactccactataacagactgcggagcgactttcatcatcggcgtatgttttccttagaaaagaatgacaaacaaagcctgaattgctccgattatcccgccgagcagaccgcctaaatacgttatcatcttaaattctctcttggaaatcgacagcaccatttcttccagccgttcaacgggaaactgatcaacctgctctttgaccacttcctcaagacgcagccgtttcagcacatcctccaaatgagcggcaatactgccgagtgccgcatcaagcagcttcggcgcgtacgtccccgtaatctccccttcataacgggagatgatgtcaccgagccggcattcgaaaaagggcgcggtttgaagtgcggccaaagcccgctttttcatgctgaacagcagatctttcgcattccacttttcatcggcctcataaagtgtataagatttgagcttgccccattcttgagaaagcagatcagccagaagctttttcgtttcctcattgcgcaaaaactttaacagctcaggcagcacacggtctgccaagcttgaattgccgaggaacatctgcaccatgccgccgagcatccccgggaattcaaaaagtcgtcaatcatatttccgagtctgtctttcccttcttcgctctcaaaataatcaatgctacgcttcaggatataatctgcggccagcgggattttttcatccagcttttcctgcagctcatcaggaagccagtctttgatggcgcggtgctcatatttccggtacaggtccgaaagcttttcatcggtaaaacggtcaatccaggcatccgtcttttcctgcggattccggatgcccgcggcggccaaagcttcgtgcaccgtcatttcggaagcggccattttttgcgtgaattgttcggcgaaaagaagcgcctggtttttaacgttatctgataaaagccgcttttttattccttccggggttaaaaggtggttcgtcaccatgagccccatttgttttgccaattcatcccgtcttttcgggatcagccccggcgtaaacggaacccgttttccgaacaggtaatacggccggtacggacgaaataacatctgaatggcaagatgattcgtcaccgcgccgatcgcggctccgatcacgatcataaatagaaacgttcctgctatgcccattccttttcttctgcctccatcttatgttctattttcttgatgatatatctattcgtattatagaggctggcgggcatgcgggcaaatgaagaacctgaattgttgtttgtgaggaataaggcaagatgctgtttcgtactctttacagtagatcatcttttatgatgcgcttagcatatttattggatggaagggccgttccatcagcggctttttgaataaagggggagtagtaatatgacaacactcggttttatgtctgtatcccgccggcacgaagaagattacgccggggaattggctgaaagagcgcctcaatataatgtgcgcttagcccgctttacaccgtttgatatatttccggattctttgcgcgtgaaagcgctcgtctatcacccgcaaagcggaaagtggaacgaaacggaaatcgatattcccgaatatatttacgaccgctgtttttacggaaaatccgctgaagcgcaaaaagccaaaccgatcgtcgaatggctgaaaaaatatccgaaaacggaatttatcgggcgggggcttcctgataaatggacggttacagatgcgctccaaaagcatcatctgatcagtccctatattcctgaaacggccgaagtcagccgctatgaacaggtgcaattatacttagccaaggaaaaagcatgtatacttaagcccgctttcggcgcgggaggcagaggcatcatcctgcttgaaacaggcaaaaaatcaattaccgccacttactatatcggaaaaaacaaacaaacaaaatcattttccaatcacgtgtcttttaagtcttggtgcaaaaaagtgctgcagcaccgctatttgcttcaatcctacttaaatatccaggataaagaacggcatccgtgcgacatccgcattttcatgcgcaaaacggagtcaggcgtttgggaaacggtcggaaaagcggtcagaaggggttatcagaacggtcttttatctcatttgcccggaggatcagaaccgattaagtttgacatatggtttgaggaaattccgagaaagcagcaggccgttttattggatgatgtcttttcgatcacccaatccgttccttatttccttgatgaacggttcggaccgctgtttgagctggggctcgatatttgttatgccaaagacggacgcatctggcttttggatgtcaattcaaagccgggacggaaagctattttaagcgtggctccggaggcgaaagaggatttgtatacgggtccgctgagacgcttccgcgaacttcagtcacaggacagcaggaagggagtattaccgcgtgaatcataaagggatgattgtcggcatcgataaaaaaagcaaaaatacgctgtttctcccctcctccatgaaacgggaagggcttttatccgctgccttcgggaccaaggttgtcaaatgccgtgtagccttttctcaatcacttgaaaaaagcgcgctcctttctgaagatttgtttgaggagctgttgataccgtataaaagccgggctgactttctcatacacggccagacggtgcacatcggaccgctgatcggcgttttcacagccgggttcacatcatcgccgtcccgcccgttaagagaccgtacagccttcttttccaagatgctctcacttcatgaacaggcgaacggatattgtttcgttttcggagctcatcagatcaactgggaagaaggcaccgtccaagcgctgatttataaagaaaacagctggaaacggacgtccgtcccgcttccgaatgtcgtatatgacaggctcccgagccgaaaaacggaaggagttccgcttttacagcagacaaaacagaggctgatgaatgactatcagattccgtggtttaatccgcaattctttaataaatgggacattcataagcttctggaaaaaaacagtctcaccgcttcacttcttccaaaatctgtcctgcacccgaatgcagaggcgttagagacgttatgcaacacatttgacaccgtctatatcaaacctgcagacggcgcactcggaacggggatttacagggtggaaaaaacagatgccggcttatctgtcaaacacacgaatgaggaaaaaacggtggtgacggcagagtattcagatgcggcatccttcatgaaatcatttaaagaaaacaatgacccgtccgcatttttaattcagcaaggcattgacctgatccggctggatggacgccccgtcgatttcagggtgcacacgaataaaaacgccgaggggaaatggacagtgacggccattgcagcaaaaatttccggtgaaaacagcatcacgacgcatctggcaaccggcggagaagtcaggacgttagctgaattatacggcgatccgcgagagagagtcggcatgatgcggaaactttccaaagccgccttggcggtcagccgcgtgttaaatgagcacattgaaggttttatcggcgaaatcggttttgacctcggcgtcgatcattcagggaaagtttggatgtttgaagccaattcccgccccgggcgcagcattttttcccatccgaagctgagatcggtcgattacctgacaaaacggagaaattttgaatacgcgtcctatttatcagaacggtccatcaccgccccggaaaaactttggcggtgaggctgtctttttttggttttacccgggacaggcacagaatgatgagctacaatgaacaagatcaacatttcctacaaggagcgtgaacgtcatgatttcgcacttcagctggaaaccgttattcaaaaaagagaaactgcccggatggcggatttcattttactggcagggtacgcattacgaaggggtttaccataagtccggtgacattgaatggggacacacacatccgggaaaagaagagccggctctcgtaaaagagctgcacgaattaatgctttatcacatatatgactgaaagctaaaagctcagccgcatcaggctgggcttttcttttcccttccgctatttaccacccggttttccgaatgagatgccctttgattcaccataatacgtagtacaaagcggcaaacagcattgggtgaagccgagctggcaatggttttcattccgaaaatcatcggctggtgcaattccagcaaacccaaccatactacttaataaaggagatcatacaaatggcaaacaacaactcttcaaaccaactattagtacccggcgctgctcaagcaatcgaccaaatgaaatacgaaattgcttctgagttcggcgtaaaccttggcggagaaacaacttctcgtgcaaacggttctgtcggaggagaaatcacgaaacgtttagtatctttcgcacagcagaacatgggcggccaaggcgtacaataactcaataaatggcttacagaaggcgcgggataccgcgtcttcttttatgccgtcacccttttttcctattccacataccctaggaaaaaaggagggaaaacatgtcattcattgcctcagtcaattgggagctgtttcagttcgtaagtgtttctttggtcaatgaatatgttgcccaccatttcccgtttattcacaggcattcttttccccgctgctttgaatgatataatgagcggcgaggaggttttttacatgaacatcgctttactcggagcaacgggaagagtcggacaggcttttataaaagaagcgcagaaacatggacacatggaaatattcgctcttgtcagatcagccggaacagtccttcccattcctgaaaaacagatcataacagggaatgcgaggcggcgggaagatgtcagccgattgatttccaaagcggacacagtcgtgagctgtctcggcacggacggtgacgataccctttcagccgctatgacccatataatagacggcatgaaacggcatcatgttcagcgtctgattacgatcggcaccgcgggtatccttcaatcacggcttatgcctgatcaataccgttttgaatcggcagaatcaaaacgaaaatcaacaagagccgcaaaggaacacgcccgcgtatacgagatgctgctggcagaggatcttgactggacgatcatctgccctacctaccttcctgacggagacgctgccggagtttaccggttcgaacaggatcgccttcctgaagacggcgccgaaatcacagtcggagacacggcacattttctgtaccgcgagctgatcagcccgcagtttgtcagaaaacgggtaggactggcttactgaatgaaaaaagggcgaatcttttgattcaccctttccgattacaccgcggatttcgccgttcctttctgtaattcatacatttgatggtactgccccttttgcgccattaattcgtcatggcttcccttttcaatgatgcggcccttttccagcacgagaatctggtctgcgtgtctgatcgtggaaagccgatgggcgataataaatgtcgtgcgcccttcttgaaccacttgcagcgctttttgaatgaccgcttctgtttcggtgtcaatgtgcgccgtcgcctcatccaaaattaaaatggccggatcgaacacaagcgctcttgcaaaagaaatcagctgacgctggcctgaggacagtgtgccgcctttttcggtgacgggctctctgatgcccttcggcaaagattgcagaaggcttgcggcgccgacttggcgaagcgcttcttccgcctgctccagagaaatacgctgatcatcgagtgtcacattggagccgatcgtgcccgagaaaagatacgggtcttgcagcacaatgcccatatgcgacctcagctcctgccttgacatgctgtatatgcttttaccgtccagcaggatatcccctttttgggcatcataaaaacggaacagaagattcaggatggagcttttgccggaccccgtatggccgacgagggcgaccgtctcccctttttcagctgtaaagctgatgtgtttcagcacctcttctccctttcgatatccaaaagaaacatcgcggaattccactgtcccttccgcctttctgtctgcgggagcgccttcttcttccgtttcctcctcctgtaaaagctcgaatactctggcggcagagacacgggccaattcaagcttcgaaaattggttgacaatccccgtaaccggctggaacaaacggtttaaataatcaacaaatgcatataaaacaccgatcgaaacaattccggccgcactcagactcgcgcctccgaaataccagatcagcccgacaaacgccagattgcgcaacacattgacaagactgtgggacatgagggaatttaaggacagcattttgtttttgtagcggaaatgagcttcattcaattcttcaaattccttcatcgtttccttctcgcggcggaacgcctgaataatcggcattccttgaatggactcgttcattttcgcattgatgtcactgttaatggaacggattttttgattgaagacggatgcatatttgcggtacacaaccgaccagatcattaaaatcggaataatcagaaggcaaacggcggccagcctgacgtcaagcataaacagcgccgtaaaaatgccgagcatataaacgccgcttgtgataaatgtcgacagcaccgttacatataaatccctcaccgcttctgtgtcattcgtaatacgggccacgacttttccggcaggcagattatcaaagtagcggatcggcattttctgaatgtgtgaaaatacatcctgcctcatgcgctgtatgatccggttcgctcccatctgcagcagataatgctgaccgtaatgaaaacatacggaaaacatgagcaatcccgcataaatggcggtcaacgtcagcaatccttttatttccggacggtaaaattcaaaaatctcctgtcttgataacgtaatgacgggatatgacctgctttctttaccgtttgatattgtcagccggccgtcagacaccgaacggtttccgtcaaaactgacgggacggtcaacaaaatagtagcccgcaccgacttgataaatgtgcgcctctccggttttatccgcccccggtttgagccggtcctccctgacataatcatgcccccggaacctgacggcgcccggatcgtccgcagaggctttaacccatgttttttcaatgccgagaatgtggtcatcaatcattttttttccgataaacgggccggtcagctcagtgccgaccgcaataatgagcaggacgaccgcccatatcagcagcttcttatattgaagcgcgtaattccataatcttctcccggtcttcatgcgcccgtccccccttcttcaagagaggacagctgctgcctctcatattgttttcgataccagccgttctgcgccaatagctcccggtgcgtgcctctttcagacacccggccttcgtccatgacgagaatgagatctgcgtgttcaactgccgagagccggtgggtggtgataatcgttgttttatgccgccgttttttacggatgctgtcaatgatggcggcttccgttttcgcgtctacggcagaaagcgaatcatctaatatgagaatatcaggatcggtcaaaagcgctctcgcaattgagatgcgctgcttttgtccgcccgagagcgctacgcccttctcgccgacaagcgtctcaagcccgtcggaaagcatgccgatatcgttttcaaaatgcgcatctttcagcgcgccgccgatttcctcttcgtttgcatcctgccgtccgtaaagcagattctcctttacagtcttagaaaataaaatatgatcctgcggcacatagccgatccacccgcggagctcctcaagcgggatctcctgaatcgggacgcctgtaaacgtgacctctcccgcaccgggcggatattcacgcagcagctgcttaatgatcgtcgtctttccgcttcccgtcttcccgacgatgccgagtgtctgccctttttctacggaaaaagatacatcggaaaccgccggtcccgctccgctcggatacgtgaaagtcacttgttcaaaaacaagacgcccgggctccttgatgccggcggggcgcttgggcccgatcacgtcaggctcataggaaagcgtctcattgacacgatccaaggaggcattgccgcgctgcatgatattgattaattctccgatcgcaaacatcggccagatcatcattccgaggtacacgttaaacgataccagctctcccagcgtcagccggttttgaaaaacgagataagcgccgtagccgagacctatgagatagctgaggccgacgagaagtttcacagtcggttcaaaaagtgaatcgataaacgccaccttcatatttttctcatatacatccgccgtcatatcaccgaaccggctgacatcatttttttcctgcacaaatgcccggatgacccggacgccggataccgactccagcaccttgtcatttaatgatccgaaagcatcctgcgcttccgtaaaccgctcatggatcttttttccgtacaggctgaccgcagccgccattatcggcagcggaataatcgcggcaaatgtcagcttccagctgatgagaagccccattgtcaaaaatatcgtcagcatatacatcgtcgaatcaacgagcgttaagaccccgaagcccgtcgtcatactgacggcctgcaggtcatttgtcccccgcgccattaaatcgcccgttctgtatttctcgtaaaacggcggtgacatttgaagaagccttcccatcagctttgaccggagaattttctccatgacattcgccccgccgaaaagctgatacatccaaaaataagacagtaaatagacggctgccgttaatgcgagaaaaacacatatgtaaaacagcatcccgcttttcgtaaacacgcccgccttcatatcgtctatcgcattaccgagaagtttaggcggaaacatctcaatgacattcacaatcaataacagaacaatcgctgtcgtatagcgcagccaataggctttaaaaaaccacgcgagcttttttaatacagtaaacaaataccgtcatcccctttcatcaatcagccgccctcaagcttttccggattgtttttcattgttttcgctaatgccgccacatgcatcacacctgtctttctttcatttttttgtataaaaaaagacatgaagcctcagctccatgcctcttattattataaataaggtacagacccgccgtttatgcgcgactgccccgtttttaagcaaatgttcagaaaacggaagctgtatggaagtcacgccggtattcagctgaagatgagttgacaagctttagttttgacatgatccatacctcctttttcctatattgttccttcatcatataaataaatcctttttttgtcaatgcgggttttacatttctgccgcacgggtattgtaaaacaaaccttttttactgaaaggatgaggctgatgtttcacgcagaccggttgatagcagcttttgacggaagtgatgatagtaaaaaagcgcttcaaaaagccatagacctttcaaaaacgttccacgcggatttaacggtcgtacattcccacagtgcaaaagatacccagacgattgttgatcccccgaggccgggagccggggcaacgtatatcggcggcgggattgcaagcgttcctgacccgcttcaggcggaaagaatctcccctgatccgatgatttatgaagaccgtacggaagaaatcgttgcggaagcgagaatgctgatgaacgacagccagattgacggggatatcgacattttagaaggtgatcccgctgatgccattatcgagcatgccgaccgtatatcggcggatttgatcgtcatggggagccgggaccagaacaggctgaaaaaacttttattcggaagcgtcagtgaaaaactgtcatcgaaatccgatattcccgtgctgatcgtaaaataattctttctgtaaagcagcttaatcaaaagctgctttttttacagctcccggctgttttttctttttttcggcattacaaaaaaactcgccatgatcaaaaaatcgatgcacaatacgacagaccagccctttaacagtccgctgagcgcttcggtgcgggaagcgtcctgaatgagaaataccgttccggctaaaagaacgccgccgatgacaaatgctaatacatgtcttccccatccttttgcataatgtttggcataatccagtccgtaccgcttgaccggttttgccccttcctttaccacataatagcggaaccgctcatccgcccactgaatcatgctttttccgaaggcgacagacactccgatataaacggccgccactgcatgcgccatagtcgccgccgcccctctgtataaatcagctgcggccgccagaaacagtacggcatccaatataggaatgagagcgaaaaaaaacattccgagcttttgccgcctgaatatatagcgcgccgccaatccgaagatgacagccgcccaaaaagcagcctcacaaatgacaatcaaccaagcaatcgcgttcaatccggttcccccttatcgttttctaaaatgcattgtatcactgctttttatttaatacaactgtattacaaaattgcaagaaaaaatatttcctgttacactggaaccatgcctaaaataatcgatcatgaaaaaagaagaaaacaaatagccgaagccacttggcggacgattttggagcggggaatggaaggagcgacagtgagaaacatcgcccaagaagcgggtctttctttaggcgcgctgaggcactatttcaccacccaggatgagcttttagggtatgcgatgacactcgtaaaagaaaaagcggccgccagaattaacgaagttgccatgaaagatctgccgccgaaagaaaaagcggtgcgtctgatgcttgaaattatcccgacagatgaagaaacgatggctgaaatggaggtgtggttcgctttcacagcttatgccagacataagggagaagagtttcaaccccagcaggacgggatcttggcatatatccgcggcctgattgactggctggatgaaaataagcttctgaaaccgaatcttgataaagaaaccgaagcggagaaaatgtacgctatcgccgacggattggcgctgcatgccatgcttgaacctgatcgtctttcaaaagagaagatctcccgtgtactcgttcagcatatcgaatctctttttatctgactggagcaaaaaggccggatgtgttccggcctttttttcagcttatgactgaacgccgagctcctgctgaatgtgcgactgaaaagcctcctgaatcgttttggctacaggtcccggcgatccgcttccgaccggttttccgtcaagggttacgatcgggattaattcagacgtggttgacgagatgaaaatttcatccgcatctctgagttcctcttcggtaagagccttctcccgcacctcaatcccgttttctttcatcagctctaacagtttcatccgcgtaatgccgtttaaaatcagctcatttgcaggatgcgtccggacggtgccgtttatgacggcgtatacattggatgaggttccttccgtgaccgccccgtcccttatcagcacggcttcataagcgcctgcttcataggctttttgttttatcatcacattatacagtaaattcagactcttaatgtcacacctcagccagcgtttgtcttccgccgtgatggcctgcgctccggctttttgttcattttccggttttttcactgaaaaggtgtatgccgtcgtctgcggctccaatccttcgtcatactggtgcttccgcggcgccttccctctcgtcgtctgtatatagaccccgccgtcaatgagtttgttttcctgtacgagcttttgcagatcccattctatgtcctctgcggagaacggcagggtgatgccgatttctgcggcgcttctgaaaagacgggcgatatgctcacgcagaccgaataaggcgccgttatacactctgatgacctcatacacaccgtcaccgaattgatatccgcggtcctcaatatcaactgccgcttcttcacgatcaatcaactggccgtttactaatgtcttcatgtaaaccctcctaatcgttatctgccgtgatgtgcattctcagctgttattgtcaactattctatcatactgaacgagccggctgcggagtttatttttttcttaaaatcttattattcgacatcttttctatgtcttttccagttttgttcctgtatacttgattcgacatacatatgctgttaacttatggcacttcgcaagcctccgctgttatcggcattatgcagaaacttatgctactggagagattgttatgcgcaacacaaaagaaggtgcttccccttctctgttttcattggcttttaaacttacgagtttagcagttttgtgcggactgcttctggtaatcgtcataatgggatattccgcttccgccgcaaaaaacaaacaggtcaccgtgaccgcaaacgggcagcttcgggatgaagcagaaagcctgcggctgaaaaatgattctcccgacgtcttaatgaaacatttgcagaaagagcgtgacccagggaaaaaaacggtatatttaaccttcgacgacgggccgtctccatatactgaacagctgttgaatgtattgaaggcaaatggcgcaaaggccactttttttatgcttgaaccgcggatgaaagcctataagcattccgtgcaaagagcgaagcaggaagggatcgcgctgggcctgcacggcgtgacgcacgataatcacctgttttatcaaacaccgacatcaccgctgaacgaaatgcagcagggacgcgatacgctcgagacaatcactggagtaaaaacggatcttgtccgcacgccttacggcagtaaaccctcattgacggatgcccagattaagaatctcgaaaaagacggattcgtgtactgggactggacgatagacagtgaagactggaagtacaaaaacgcgcggtacgtgccggaagtattgaatcagctcgcatatttggaaagcgttcatacgagcaggccgcatgtcattttaatgcacgatctgcctgcgacggtgcacgctttaccgagcctgatccaaaaactgaaagcccagggctactcctttgatgttctgacggatcaaatgattcccgtccatgaataagaaaagccggatctgtataggatccggctttttttatgtcgcggcgctgatccgttttgcaaattcaccgatcttctcatggatgacaagatcaaataaatggtcgcaatatgtcggctcaaggttaatgatcacttgcttcaaaccgggaatccggcccgcatcctcagggacaaaccttgccggcgccacttcaagcgaagtgccgatcacaagaagaagatcagctttatcaagcttttcataaagggtttcaaaatgctgaacgagatcgccgaacagcacgacatccgtctttaatacggtgccgcataccgcatgatcaccgacttcggccgtacattccggcacttcgtccttcagcagatgagaaagcccgtagcgcgctccgcagcgggggcatgcggcggtctgaattgaaccgtgaagctcatagacactgctgcttcccgctttcttatgcagtccgtcaatgttctgcgtgaaaatgtctacctgctttccccgcttttcaagatccgccaaatacgtatggccggcattcggctcatagcttccgctcattttcatctgaaagagctgtttgaatttaggccagaattcacgcggacggcgttcaaagtattccctgctcatcgcttccattctggaggtgtcttcggtccatataccgcccgccgaacgaaaatcgggaatgccggattccgtgctcattcccgctcccgtcagcaccaggatacgttcagcctgattgatcaatgttataaacgcttccactcttccaccgccttttctttttatcatatcatgaaaaaagaacggcgcctgttatgcccgttctttttctccggaatgatccttcacatgaaccggatcatcgtggctcttctgttttacgaatacattctggcccggataggcgaactccacgccttcctcagcaaaaatatcaataatccggcggttgatatcctgccgcacgtccaggctttccgcccagacgatggtctttgtgtaaaagttgaaaaacagattgtaatagctgtccgcaaacacgtcaaagttaaccataatcgtatcatcatgcacgccttcatgttcacgaagcatttccctgagccttgtgatgcaccgctctaaacgatcaatcggcgtcgcataagaaacacgaacggaaaacgtgacctggcgcttcgtcatcctcgtccagtttgtgatggcttccatggacagcgttgaattgggtacggtaacaagcgccccctgcgccgtgcggaaccttgtgcttcggaatgtgatatcttcaacgccccccgtcacagatgacgtctcgacccagtcgccgatcgtaaacggcttttccgtaatgatgataatgccgccgaaaaaattgctgatcgtatctttagccgcaagcgcgaaggccaagccgccaagtccgagtccggccacgaacccgtttacatcataattgaattcctgcgcgatcacactgacgctgagcgcgagaatgacaaagcgcagcaccttggataaaaacggcgccaaaatgtcatccatatcaagctcaaagcgctgattgactttatgaaataaaaacgaagacgccgatgtcagattgcaaagcccccaggcgatcagcgctatgatcaaagagcggtacatttttttgacaatgtccatctgcccgtctaaaaacggcgaatactcaatcgccaaaaacagacccagcgccacgaaaaaccatctggccggcttgtcaaacgctacggcaatctgtttgaatatgtcggttttcggcttgttcgccaatttgtaaatgagctgaaaaaagtatttgacaaacagttttctcaaaacgagaaaagccgctaaaattccgatgctgatactgatctgcaaaatatggtcaagagtaaaaaagctctgaaattgtgtcatcatggcatatgctcctttgtcttgtcgaaaatctattatactaaaacattcggacatcagcttgttttaatgtctttaggcagcctgaaaaaccccggcctcagagcacagccggggtttttcacacattcgttcatctttcagccagatacaacagggtcaggcactatttcttctttgattgtgtctgtttcaggagagtcgctttttggatttcagcatcggtttcggccttaattctttcttccactttcaatctcccttttcccatgatctcgcctcctttttgccattataaatcatcactgcggattgtaaaccgaaaaaagcactatctttattccaaaaaaatactgttttgcacattcaccagtttgaatcgctgtgcatatacgaatctgatataataacagaaatgcccatgaggggagctgacaagcttgtataccatcgctcatcgcggcgcatccggttacgcgcccgaaaatacatttgcggcatttgatatcgctgccgaaatgaacgctgatttcattgagcttgacgtccagctcacaaaagacggccagattgtcgtcatccatgatgacaaagtcgaccggacgacggacggctccggttttgtaaaagattttacgctgaagaagctgcagtctctggacgccggcagctggtatggggctgagtttaaaggggagcggattcccctgctcgaagaggttctgaagcgttatcattctgaaatcggatttttaattgaactgaaagggcacgtttctcaagtcggtcttgaaaaagcagtcggccagctgttaagcaggtttaccttttccattcaccctatcgttcaatcattcagtctcaagtcgattcagacctttcacgacatgtatccgtccgttccgactgcaattatcgcaagacccagcttcgggatgttttccaaaagccagctggccgcttacaaatcagccgcaaattatgtcaatattaaatatacccgcctgaatcggttcttgatttccaccgctcacaaacacggcctgaaagtatttgcctggacggtcagaaatcacaagacggccgaaaagctgcaaatgatggcagttgacggcattgtaactgattttccggatattatttctaaggatggctgatatgaaacaatacatcgcaatttttatcggaggcgcgcttggcgcattgctccgctttgaaatgagcgcgcacattcacagcggaactttcccgggtgccactttcctcgaaaacgcggcgggaagccttttactcggtcttattacgggttatttcatcattcgggctaaacgccctcttttgaccgcctttttaggaaccggtttttgcggaggtttcacgacgatgtcaaccttcgcaaaagaaaccatttttctgctgcaatcgtctcccgcagcggctttttgttatgctgccgcgactttattcgctggtcttgctcttgcatacgccggcatttttttgggacggcggattgcccttcacgcagccggaagggggcatgatacgccatgacgattgtcctgatgcttatcgcggcgggtatcggagcggtattacggtctctgctgggtaagacaatttcagaaagaacaaaaggttttccgattccgcttggaatggctgcggtcaacctgctcggctccttcagcctcggcatattcaccggcttgggtctggataatccttctgccggcgtcatcatcgcgacgggctttttcggtgcgtttacgaccttttccaccttcagtattgaagccgtgcagctgatgatgaacaaccgcataaaggaaagcctgctctacatcgctgtttcagcagccggaagccttttggcgttctggtgcggctttgttatgatatccatttaaaaaaaccttgagcttatttttcgctcaaggttgcgttatgaagcatgaccgtttccggcacgggcagcgggcggtttattgtcccctgaccgcccgggcggccctgttcttctttgagttcaagctgtttaataaaccggccgtccatttctaatatgagggcagtgtatcccccgatttgtatcgactcacccgcacaaatgtcaatattccgtttcagcacaagaccgccgatcgtgtcgacttcctcttcaatctctgcgccgagaagatgattcacctgatcgatccgaacctttccgtccagcacataatggcgttcggacagcttttgaatctgcggctgttcgtcctcatcaaattcgtctctgatatcgccgacgatttcttcaagtatgtcttcggtcgtcacaagaccggacgttccgccgtattcatcagacaatatcgccaaatgaatccgttctctctgcatttttatcagcaggtcgtgtatcgggatcgtctcgatgacttcaatcaccgggcggacgtaagacatgatggatacttccgctttttcatcttctgtcataaacagcagatctgaaaagagatgcttcgtattgatcatgccgatgacactgtctttgtccccgtccgttacgggccagcgcgtatatttgtctttcagcatcatatcaagcatttccggcacgtccatatcagtggaaacagccgcgatttcttttctcgggatcatgatttccttggcgatccgattatcaaaatcaaaaattttattcacaaatgtatattcagacggattgatttctccgttttttaaactttctgacagcaggatccgcagctcttcttcagagtgggagccttcatgctcagatgccggctttaatccggccaaaccggtcagaattctcgcggagccgttcagcacccaaataaacgggaacatgaacacgtaaaataaccgaagcggtccggcaatccataacgtcagcttttccgctttttgaatcgcaaccgttttaggcgcaagctcaccgacgacgacatgtaaaaacgtaatcagcccgtacgccgcagcaaaagcaatcacatgctcggcagaatccggcagccccataccctgaaacacaggatgaagcatccgctcaaatgcaggctctcccagtacgccgagcccgatggatgtgagtgtaatgccaagctgcgaggcggataaatactcatcaagatccgtaatgatacgctttgcgagcaccgcccgtctgtttccttctgagatgagctgatcgattctggatctcctcactctgacgatcgcaaattcactcgccacgaaaaatgccgttaacgcaatgagcacaccgattaaaatcaaactgtcaatatcgtccatttcaccttatcccgaattgaaggataaggacgtcacctcctgatttcatcgttttttcttaagcgagaggaacgaaatgggtgattgactacacagagggccccatcctgccacctcctaagtcaaagcatgattgtcatttgtatagtttattgtatcacaactccattctttcatcattttcagatttttcatcatataaaaacagccttcaaaaagaaggctgccgttatctgcttcggaaatgattttctaaacaaagcgccgtattaatcccccgaatcccatgcttaagcttaacgcatggtgtacggtatgggcgctcggcccgtcggtcacccactgaaatgaatcgtcaatcggctccgttaagtttcggatcggatgaagcttgttttcccgcatttgcaagagaacagcaatgatttccaccgttccggccgcactcagaccgtgtccggtaatcgattttgtcgcattaatccgcgcgtgcgacaggccgctttcagaaagcgcccggcattcagtcttatctccgatcggcgaaccggtgccgtgcgggttgatgtaatcgatctctttcgctgaaagaccggcccgctccagcgcctggcggatcaccgtcatttcgccctctgctgaaggattcgggttgcggttcgcatcggaagccatcccccagccctttaagccggcccacgatcgtgcgcccctctcttcggcagattcagcgcgctccagcacaatcgccccgcacgcctctccgaatataaacccgtccgtatgccggtcaaacgggcggcaggcggcttcaggccgttcagcgtatgtatcagtgcccatcgctcccaaagaacggagagcgtgacactccatgtacgacagatcggccagcgccccgatcacgatgcaccggtcaaacaggcctcctttaattccttgagcagcctggataaccgccgcctggccgcttgccgacgcgccgccgaccgtaaaggccggcccttttatcccgaattgctccgtgcaaagccccgacaaatcactatccataaaagaaagcccgtatgtcggatttacaaattgcggcgtttcaccgtttttctcaaaggcctgcagcaattcgcgctgcgtcatattcgacccgccgatgatcagaccggtgcggctgtgatcagcgccgtctaattgagcgtcatgccacgcttcatataaagcgataagcgccgtctttcctgataatgcggcccttcggtacaagcgcttcgacagcgcgtccggcggcgttaattcgctaagctccgcgccgataaacgaactgcctttctgccggccgggacgtttcatcacatcaaaggcgtgccgcccctccatgagcgcatcgagaaacgcctccttgccttgtccgaccgcggttaagactccgattcctgtaatgctgatgtctgatgtgccattatttctcctcgacatttgtccgttctcccatctttatgtgttggaagctatgaagaaaaatcttgatacagtgctttgaaaatatcgcgcgactgtctgatctgttccgaaggcacgctgaaagataatcggaaatagccgctttttccaaatccgctgccgggtacgatcaatagtctgtatttctgtgcggcatgcatacagaacgccacctcgtcttcaatcggtgatttcggaaagacgaaaaagcctcctttcggcatttcaaattcgaagccggcttctgtgaggatgtccaccataaggtctctccgctttctgtaaggttcagcgtcaatcgaaagatcatccattttcgccacggcgcgctgcatcatgaccggagcgttcacaaagccgagcgtccggttgcagaaaacgaacgcatccgtcagaagatcgccctcaggcatttgggcgtccgccgcgatatacccgagcctttcccccgcaatgccgagatctttactgaacgaactgactaaaatcacgcggtgatacgcctgaaacggattcgcctgctcttctccgtagatcagctggctgtacggttcatcaaataaaataaatatgctttggccgttccgctcttcggcttcttttaataaggcgcctaattcgttaaggtttttctggctgagcacagtccccgtcggattatgcggcgtattaacgatcagtcctttcgtacggggtgtgatcgcacctttaaccgcttcaatatcaatctcaaatgagtcagtcagcgggcagatgacgggtctgccgcggtaattttcaacatacgctttatattccgcaaaataaggcgaaagaaggatgacttcttcctccgggtttaaaatgctcttcagcgcgacattcagcgccccgccggctccgaccgtcataactgtatgcctggcggaaatctcggtctgaaaccgctctgacaaaaagcgggcaaccttttctctcgcctccggaagcccttggttttgtatgtatccgtgccgccctgtttcagccgcttcgcaaagcgcctttttaaacgtttcaggcggctccgcaaccggatttcctattgaaaagtcaaacaccttatcggcgccgaactcttttttcagccgagcgccttcatcaaatagtttgcgtatccatgaacctttctccaggttctgtgtcacttcccttgataaaccggccactgtcatctgtcccttctgtctttttctgccgtttctatttacaatgattatgaaagatttacatggcgcagtcaacgctttttcagacagcctgccgccccgtttcaggagaaagacggaaaacaataaacttgtgcaaactccccttcatatattaaactattctcataactataacgtgatggttggggagggatttagatggggctgagacttatcgcatcagtgaattagcagagcttgccggtgtaacgaaacgcacggtggattactacacaaacctcgggcttttaaagcctgacaggtcttgttcgaactatcgttactacgatacacttgcacttaatcggttaaagtttatagtcgcttgtaaaaagcagcgattggccctgtctgatataaaagatcgactggagaaccagtttccctcttcagccctgcctgacgatgttggaaatctggcatcggaaattgatcacatgaatcaaaacatctccgggatcttgaatcggtttgaaaagcttgaaccagaggagcgcgcccagctgaaaaaaaggctggctcctgaaaagcttgcagtgcttcaatcatttatgctgctgttaagttaaaccattatcttactaacaggaggtgttaccttcatcttcccaaaaggagtgaaggttctaattggacattgtgaatttgattttagtcgcggttttaatcgcgctgacggcatttttcgtagcatctgagtttgcgataatcagaatcagaggctcacgggttgaccagcttatagcagaaggaaataaagccgcaatcggtgtcaaaaaagtgaccacgcatttagatgagtatttatcggcgtgccagctcggcataacattgacttccatcggtcttggtgtcttaggcgaatcaacgattgaacgcttgcttcacccgcttttcacaaagataaacgtaccaagctcattatcgcatattatttcatttattctcgcctacgcgatcattacattcttacacgtggtcgtgggagaattggcgccgaaaacagtcgccatccagaaagcggaagccgtttcaatgctgttttcgaaaccgctcatttggttttaccgcatcatgttcccgtttatctggcttctgaacaactccgcccgtcttttaacgaagacgttcggtctggagacggtgtctgaaaatgagcttgcccactctgaagaagagctgcgcatcattttatcggaaagctataaaagcggtgaaatcaaccagtctgaatttaaatatgtgaacaaaatctttgaatttgacgacagacttgcaaaagaaatcatgattccgcgtacggaaatcgtcagtctgccgcatgatatcaaaatttctgaaatgatggatatcattcagattgaaaaatatacccggtaccctgtcgaagagggtgacaaagataatattatcggcgttattaacattaaagaagtgctgaccgcctgcatcagcggcgaagtatcagtcgactcgccgattacggattttgtcaatccgatcatccatgtgattgagtcggcaccgattcacgatctgcttgtaaaaatgcagaaggaacgggttcatatggcgattctgtcggatgaatacggcggaaccgcggggcttgtcaccgttgaagacattattgaagaaatcgtcggggaaatccgtgatgaatttgatatcgatgaaatcaatgaaatccgcaaactcggcgacggccattacatgcttgacggcaaggtcctgattgatcaagtgaacgaactcctcggcatccatttggaaaatgacgaggtcgacaccatcggcggctggttccttacccagaaatacgacgtcgaacaatacgactcgattatcgaagaaggctgcgaatttatcattaatgaaattgacggccaccacgtcgcatatatcgaagtgaaaaaactggcgtttgatgaactgctggaaactgccgaacaaaaagaagcataacaaaaaagcttgcgcgtctgatacagacggcaagctttttttcatttacagttgttcaagttttttctcaagctctttaattctggcattcagctcttctgtcatggccgcaagcctctccttcggcgcaagatcggaaaagtcctccaaaaaaatcggctcgccgatgataagccgcatttttccctttttaaacagcgcttttcccgtagacggccctttatatgcggccggaacgagcggcgctttccccatttgggcgatggtcacggcccctcttttcagcgggacgtcttcagaagttctcgtgccgctcggaaaaatccctacaatcttcccttccttcagaagcttaatcggcgttttaatgctgctcggacccggattttcacgatcaaccggaaacgcgtgaatcttctttaaaaaacttccgatccactttttctgaaacagctcttttttcgccatataatgaatctgatggggcaatatcccgacaccgagcgtgaggacgtccacccagcccgcatgcgtgcacgcgataacgaatcctttatcagacggaagattctctttattgtatactttgactcctccgcgcagagaaagaatgaatttgatggcatttgcacaaaacttatacataacgcacttcctttgttgtaatgatcaaaagtgttctctctctattataacaatattttttattacctggtactaataaatatatttttcctccgccgatctctatcttttatgacggattttgggtactatagagaaatggtgtttgatgaggtgaaaatgaatttaagccgtttgcatggaacgtgcaactttaaacctttcttatgcgtgtataacatagaggggagaaaaggcagtgacgatcgatgaaatttaccaaatgtatatgaatgatgtttaccggttcctgctctccatgacaaaagacaagcatctcgctgaagatttgctgcaggaaacctttatgagggcatacatacacattcactcctacgaccacagcaaagtaaagccatggctttttcaagtggcgagaaatgcgtttatagattatgtcagaaaacataaaaaggaagtgaccatttccgatgacttaattgggagcctttttcagacggctgttcaaagcccggctcatcagattgaaatcaaggaagtgctgacagggtatatgtccgaacttcccgacaattatcgggaggccttaacactgtattatttaaaagaactgaattacaaagaagcatcccatattatgaatatttcagaggctaattttaaaagtgttttatttcgtgccagacagcggctgaaagcactttataatagaggtgttaatgatgaatgaagaatttaaaaagcgtttttaccaatacaaaaatggagaaatgagcgaccgggaaatggccgcctttgaagaagagctggaaaagcttgaagtctatcaggagttgattgaaagcgaaatgcaggacgaccgggaatgggacgtcggcatcagcccggaaaaacagaaggccattttgtcatacggaaaacgcaaatcgtatttgcggatttcagttctcgccgtcatctccaccttgatgattttgccgctttgcactttgggaagctacctctattacggtttgggaggaaaagaaagcaccggcaatcaattaatggaaaccgcagccgtgacggtggcgaccaccatgccgaacgtactcgtcgatacctccggactgaaaagccaggtgaagctgtttgggatgaatacagagtttccgctgcaaaagcagatcggcacaaaaacgaaatccgtcggcggagaacggattgaaatgtttttagatacggtcaaatcgcctgccgttaactactatgatctagacgcggcacaggcaaagcattattttgcccatccttccggcttaaaggaacgcacgattgacaaagccggacagacattaaaaaaattgcctgaaggaagcgtggcggaggtctatctttcttatgaccgggcctatccttcttctcaagtatattctacttttaaaaaatacgatgtgaagtttttatggaacgcggtcgaaacggagaaaaatctgaaagacagtccttatgccgagccgttaggatttcccgggaaagattccaagatggtgtcctctttcgaaacgcaaggacagacagaccgtgaacaatttatcaatgcccttgaatttatgtcccgccataaaaaatgggcgcatgcaatatcgaaacgcaaagacatgaatcttggcagccgaatcgactatgttgaacatcacggaatgaacgtatacggctctgtcgtgacggggccgacaaaagaaatcgaacgtctgctgaaaaataaaacagtaaaagcagcaaacatcggtgaggtggaattatggaattggtaagaatttttaaagagcataatgttttcggctggatatcagtcggtaccgcgattttgtcgctgctgcttttgaacgtggcaatcatcagcaatgtgactttctattcttatcagatgctgccgtttgcgatggccgccgtgccgttcggcatcattgagctgtttattaaaaaaggacggacgggcccgggactgctcggtgtcatcctcaaccttttcgtcattgtttgtgtatatacgatcgttgccgttgatacgaatctgcaattcggtttttaaacataaaaacaggcccttttacaggggcctgtttttttaaaatgaaagaacgccgattaaatgcagcaatacgacgatgatagccagcggcacgaggtatttcagaaggaaataccacacctgaaagaaacgatagccgatggcggaaccgcttttcatctcggcgaacagctcccgcttcggtattttcagcgggatgaagattgatattaataaagcgccgagcggaatcagcacattgctcactgtgaaatccgctagatcaaaaaacgtttttccgaacaaatgaacatcaccgagcacaccgtatgataaacacgacggaattccgactaagaaaatgagcagaccgcttgtccacgacagcttcttccttttcgtttcatcacctttcccgacagtcgctacgataatttccaccatcgaaaaggccgaagtcagcgcggcaaagaaaaagaccgccagaaagctgataaaaaacagcgagccgaacggcagccggtcaaacacagccggcagtacggtaaacagcagtgtaggcccttcatccggtttaaatccgaacgaaaaaaccgccggaaaaatggccagtcccgcaaacagcgtgacgagcacattcatcacaacaatggaacccgccgatcccggaaggttttgggttttcggcagatacgaactgtatgtcaccatgaccgaaacgccgagcgttaatgtaaagaacgcctgtcctaaagcatataggatggattccggcgtcaaatcttcaaagtgcggaaccaataaaaatctaatcccctcaacggcatgatcgagcgtgactgatcgcagcaccagcaatagaaacagcacgaataaaaccggcatcagcaccgcactgacacgttcaatccctttctgcacgccttttgcgacgaccgccactgtcaagatcataaatacaagctgcgcggcgagagtctggatcggattttcaatgaccgtcccgaacaccgttccgtactgctcctgagtgagcccggataaagaacccgtaacagcttttaacacataaagcaaaatccacccgccgacaacactgtaaaaagacaaaactaaaaaacaggccgccacacccacataacccgtgaggtgccataccgacttcggcgcggcttgtttgtaggcatcaatcgcatttgtctggctccgtcttccgaaaataaattcaccgagcaaaagcggatagcctaaaagcacggtaaagaggacgaatacaagaaaaaaagcgcctcctccgttcgtacccgctacgtaagggaacttccaaatggctcccaggccgatcgccgaaccggcagcggccataataaatcctatttttgaggcccattgaacccttttttggtcagacacgactttccacttcccttccgccctatattatcccttattcactgcgataacttaagcccatttcaatatgtttcattattccgaaaaataaaaaggagcggcgggtgccgctccttacaaatccccgtttaatttcgaatgctttctcgaatataagaaataaatcaccagaccgatgatcagccagataaagaaacggaatatggtggtggcgccaaggttaataatcaaaaatacgcagaacagaatggacaatatcggaataaagggaacccccggacatttaaaagctctcggcagatcaggctgtttctttctcaatacgataaccgccactgaaatcaggacaaacgcggcaagcgtgccgatgttcaccagcttcgccagctcatcaagcgggacgagcgagccgagtaatgccgacaggatgccgaacacccatgtcaccacgtgcggcgttttatgcttcggatggacttttgaaagcgcccccggcaccaaaccgtcacgggacatggcaaacatcaccctcgtctggccgtacagcatgacgagcatcaccgttgtcattcccaacactgcaccgatatcaataatcccggccacccaattctgtccggccatctgcaggacgagagacacgggatggtcaacgccttcaaagcgggcaaacggaacgacgcccgtcataatcgccgatacggtcacatacagcacggtgcagacgattaatgaaaagataattcctttcggcagatccttcgccggatttttcgtttcttcagcggcggaagagacggcgtcaaaaccgataaaagagaagaaaacgagcgccgcggcactgaaaacaccgccgaaccccatcggtataaacggctgccagttgtgaggtttgacatatacggccgcaacggcgataaacaatagaacaaccagaaccttcaaaatgaccataatattattgacccgcttcgattccttaatgcctaagtagaggaggaatgtaatcgcaagcacgataacaaatgcggggagattaaagaatgtgaccgtgcctttaatggatcccggcgcggccgttaatgcggtcggaagatgaatgccgaagcccgccaagaatgattgaaaatagccggaccagccgaccgaaaccgcgctgacggcgagcatatattccaagattaaatcccatccgatgataaatgcgagaagttcacccagtgtcgcataagtaaacgtgtagacggaaccggaaaccgggacgcttgaagcaaattcggcatatgacaaagccgcaaataaacacgcaagagcggcgatgacaaatgaaacggtcagccccggccccgccgtgacagcgcctgttccggttaatacaaaaattcccgttccgatgatggcccctatccccagaagtgtcaaatcaaaggcccctaactctcttttcagcgacttttccccgcccgttgcggcaagcaggtcctgaatgcttttctttctgaatatgctccccttcatctgcttcactccttgtaaatcaatatatgttagaatattcagacaacaatagcaataatgactaaattcttatttttcgcatgaaatgtttcagcacatcattcctttctcctacaccatattatagcgaaaaatataaaaatgaaaataacttttttgaaaattctatatattatttcagttttcataaaacagaactcagcggattctccgctgttaaatattaacattagtaattcagctggcggcttctattttttaaaaatcgtattcatatgtaatcaaataaaaatcccgccctttttaaaagcgcgggataagacttgcttattatgttgaaataaacctgcctccatttacgtgaatggtctgcccagtcatataggaagattcgtctgaagccagaagcacataagctcctgcgtgttccgcaggctgtcctggtcttcccatcggagtgtccagaccgtgcttttccaccttttcttcagtaaacgttgccggaatcagggcggtccagatcggcccgggtgccaccgcatttactctgatcccctgatcggccaatgacatcgccattgaacgcgtaaaggaaacgatgccgcctttcgtgcacgaatagtcgatcaatgatgtgtctccctgataagcggtaatcgacgttgtattaatgatggcgctccctcttttgagatgaggcagcacggcttttgtcatatgaaacatggaaaacatgtttgtacggaatgtcttctccagctgttcagccgtaatatcaagaatcccgttttgcggatgctgctcagccgcattattaacgagaatatctatttttccgtagtgatctaagacttgctggaccgccttctgacaatgcgcctcatcaccgacgtctcccggaattaacaggcaatcggcctggtattctctcgcacgctttttcgttctctcggcatcggcatgttcgtctaggtacaggatggcaagatccgccccttccttcgcgtaagcgatcgcagccgctgcgccgatgccgctgtctccgcccgtaataacggcgacttttccttttaatctgcccgacccttttacatccggatcctccaagagcggttttggctccatgtctgactcaatgccgggctggcggttttgcacctgcggcttttgtccttccgtctgtctgtccatcggattcatattctcacactcctgcaattggtattactgagacgataccacgcagtgcggggagttaaacggacaaatatgccggtaattaaagctgctgagccgtttcgggaaaagcgccggtgtatttcgcagacggtctgtaaatcatgttgtcagcggactgttcaagcacatgtgcgcaccagcctgccattctgcttgctgaaaaggtcggcgtaaataaatcattgtcgacatcaatggcctgcatcacagccgctgcgtaaaactccacattcgtatacagcttccgtccgggcttatattgctctaacaagcggatggcttccttctccacataaagcgccaagtcaagcgacggatcatttcccgccacttcttcagcctttatgcgcagcgcttccgcccgcgggtctttcgttttgtacaccctgtgcccgaagcccatcaggcgttctcccctcataagcttcgctgtcaaatacgcttctgcattttctttttccccgatgtcttcaagcattttcgtgacgcctgaaggcgcgcctccgtgcagcggccctttcatcgtacccagtgcggcagtgacggcagacactaagtccgattcagtcgaaaccgtgactctcgctgaaaaagtcgatgcattcatcccgtgttccatcgccagaatcatatacgtctcaagcgctttcttttgggctgcggacggctgcctgcctgtcagcatatacaaatagttttcaacgtgtccgtatcgcgcctcgggtgacagcgcttcctgcccttgtttacggcggtatctgtacgcaataatcgtcggtgtgacggcaatcagtttaatcgcttcttccggcttgggcggatatgtaaatgaatctgtgcccaaacctgaaacagccgttctcagcaccgccatgtcgtccatttcatccggaagcgtttccagtaagccgatcaaatgtttcggaagcccgcgctcggctgcaagttcttcctgaaacgcaagcaattgccgctcatcaggaagcgccccgttcaaaatgagatacgccgcttcttcaaaactgaattgcaatgcgatatccttcgcgtcatagccgcgatatattaaatgccccttttctccgtcaatgtggctgatcgccgtttctgcacaagtaatccctttcaatccacgataaatcaatttcattcccccttatcctctttctgttattatagtaaatataatatttaaaaaataatgaatatttttaagggaattaattaaaacttttaatcagaggagtgcatctatggattttaaatggcttcacaccttcgtcaccgcggcaaaatacgagaatttcagaaaaacggcggaaacgctttttttatctcagccgaccgtcaccgttcatataaaattattagagaaagaaatcagctgcaagctgtttcagcggagcggccggaaaatacaattgacggaagaaggaaaagcatacgtgccgtttgccatgagacttttggaagactatgaaaacagcatggcggagctgcacagggtgcgccagggctactcgcacacgctgacactcgctgtttcgccgcttatcgccgacaccgttctcccgtctgtcatgaagcgttatacagaggacaataaagaaaccgaaatgacggtcaccattttcgaatcggaagaaatcgcctctcaaatcagaaacggctcagccgatatcggactgagctgcttaaaggtgcaatcatcttccctcacttgcctccccctgtacaatgaccccgttgtcctcgtcgcgccacccggccgaaaacccgggacagggaaggcggatgaagtgaaagacctgttcggacaatatctgcttttgacccataaccatcctgactattgggatgatttgctccgccaggtcagaatacagttccctttcgtcaggacaatgaaggtgacacagacgcatattacgaaacgatttattaaagaggggctgggcgtctcatttctgccgctgtcagcggtacggtccgaactcgccgcaggcagcatgattgaaattccgtgcgaattcgcccagatgccgagcgcgggcgcgtacgccatcgccctctatgaaaatgaaaaaaagaaaacctttttagattttttatcacattttcatttttaggtgaaacaaatggagctctgccccgtctaaataaaaaacccgttcggatgaacgggtttctctcactgctagaatcttttcgcgcccaggtagcgcggtttccagtagctgttattcagatcacttgttgtgacgccgtcagaaccggcatggatgaacttgttgtttccgatgtatacacccatgtgtgaaggaccggcttgatatgttgtaaagaagacgaagtctcctcttgacgggctggatacgctcttcattgagctccagtatcccgcagtgcttgttctgccgacactcgtctgtttgtttaacaggtaccagataaatccgctgcagtcaaagccggaagtcgttgttccgccccatacatacggcgtgccgattaaagattgcgcatcagaaaccagcttgtttacattcaggctcgtctgtgcaatattatggctggatgaaggcttctttgatgacgaagatcctgaagacgctgaaccggaagttgatccttttactttaagcacttgtccgatgcggatcaggtccgtttttaaaccgtttaaactttttaattggtttaccgtcattttatatttattcgcaattttccaaaggctgtcgccttttacgactttatatgtagacgatgatgacttgctgcccgaatttgaacctgaagatgatttaccgttgatcgaaagcgtctgaccgatgtaaatgatatccgattttaatttgttctcagatttaatggaattaattgacgttccataccgatttgaaagtccccataatgtatcgcctttttttaccttaatcgtttgcgcagacgccgcgcccgcaaacaaagtcgtccccaaaaccactgccgttgttgctgtaacaagttgctttttcatattttcctccctgaatgattctatctattttatgtgtctcttttttaaagtttttatctgtttcctattataaggttcaatttccactagaaatagacttgacttcccgtgacaaatttcttactaattcgtttttgaaaaaagtttttaagggtattaaatatttcaatttgatttcaaacgtgacgaaaaacgagtcaatttgtcatgtttttttcctgtgatcctcgtattttggaaaaacaaagcagtttactttccaaataactccttgttaaaaaaatcctcgtctttttcaaaaaagtgaatggttttcactctttcttgaaaacataagttacaccggaatttacatttctaacaatgtttcacctgaaatttacaggaggaacaggcgctctttacaaacaccccctaccattagacatgcagacacgattaaaggaggacgagtgagaatgagtctatttaaacaggttcgatcaaaacttctgccggcggcagccgtatccgtgctgacagccggtctgattgcgggcgcggggtttcagcactctgaacaggctgcggcaaaaaaacagcctgacaaaaacgagatcagaaacgtcatcttcatggtcggcgacggaatgggcgcaccctatatgaacgcctaccgttcggtcattaacaaaggaaagccttcggatggtatgaaactgacggcattcgaccccaatctcgccggtatgatgatgacttatcctgacgatcctgattccaatattaccgattccgcggcggctggcacggcaatggccacgggcgtgaaaacgtataacgcggcgatcggagtcgataaaaaaggaaagcgggtcaaatccgtcctcgaagaagcgaaacaaagagggaaatccaccggacttgtcgcaacttcggagattgcccacgccacccctgcggcattcggagcccataacaaatcccgaaagaacatggatgagatcgcaagcagctactttgatgaccgcatcaacggaaaacaaaaagtcgatgtgctcctcggaggcggcaaatcaaactttatccgtaaagaccgcaatgtaacaaaggatttcaaaaaagcgggatacagctacgtgacatcaaaacaggagctgaaaaaggaccgtaacaagaagattctcggcctgtttgccgatggcggactcgacaaagcaatcgaccggtcaaacgctgtcccttcattagaagacatgacaacggcggcgatcgacaggctgaacaaaaataaaaaagggttcttcttaatggtcgaaggaagccaaatagactgggcgggacatgacaatgatatagtcggcgcaatgagtgaaatgaaggattttgaaaaagcgtataaagcagcgatcgcatttgccaaaaaggacaaacatacgcttgtcgttgccacggctgatcataccaccggcggattgacgatcggcgcgaatgacgataaaaactggcatgttgaaccgattcttgccgccaaaaaaaccccggcatttatggctgaccaaatcaaagcgggcaaatccgtatcttccgtgcttgcgcgttatacagacctgaaatggtcaaaagcggaaattaaacagatcgaaacggccgcaaaacaggatgctgacaagagcgtctacaaagcgatcattaagctttttaatgcgaaaacaaacagcggctggacaaccggcgatcatacgggcgaagaagttcccgtttacgcatacggtccgggaagagagtcatttacggggcttttaaacaacacggaccaggccaaaaagatctttcacatcctgaaacacggaaaataaaaaaggatgcggggatttccccgcatcctttcttcttttacaaatatctccggtgcactcctttgccgtcatacgaaaacatcacttctctgtcttcaagaacagattcgatgtgcacgctcctgccccacagctggtacagatacggcagcactttctccaaatatttcagatcaagctcaattccctcataccaatgtttaatataaagctcattattcttcaggtaatccccgtcattgacggtcagataaggaaatcccccgttgacccgcatgttcacgagctggtcgcgcacggccttccattctttgtcgatcactttatagtccctgccctgcttttggaataaatacaaatcctcacgcataacgagatctttcgtcaaataattgcggataaatgatatgtccgattcaatttccctgacctcaaacattttctcgcggccggaaccgggctttacccctgtttttttcatttcatctgtcgggttgtcataacgctcttcgatgtcttcaaaaattttcagccctaaataatacgggttgattcccgtttttgacggctgaacgacgcctgcgttcagcttcgcaaattcgatggcttcatctgaagtcaggtcaagctcgcggataatccgctgatgccaataggatgcccagccttcgttcatgattttcgtttccagctgaggccagaaatacagcatttcttctctcatcatggttaaaatgtcacgctgccacggttcaagctcccgcgaatgttcctcgataaacagcagaatatctttttccggacggggcggaaacggttttttccctcttttctttttcacctgtttcggcttatccattccccataaatcatcgtaaggcgatggcgcggtttcttcttcgtcctcctcttcgtcatcgacgctccacagcagcttcggcctgacgagcgacggatcgatatgctcctgaatcgccagaatggcatctaaaaaggactccacctcttttatcccgtgaattctttcataatgcttaatccgctccgccgcagccgccatactctcaaccatgtcccggttcgtattttgaaagcggcagttatttttgaaaaaatcacaatgggcaagaacatgggctacaattaatttattttggatcagcgaattgctgtccagcaaaaaagcgtagcaagggttggaattaatgacaagttcataaattttgctcaaaccgagatcataatggagtttcatcttatgaaattgtttgccgaaactccagtggctgaatctcgtcggcatgccgtacgcgccgaatgtataaataatttcagccgggcaaatttcatatctcatcgggtagaaatcaaggccgaaaccctttgcaatgtcggttatttcctcaattgcccgctgtaaaccttttgtctcctccgcgttcaagcgaatcccccctacttggacttatttataatgtatgacccctcctctcaaaagatgaaataacagaccggtttccgactgaaaactttcggcacatccgccctgtttgctttatatgtaagtgggtaaaacacacaccataccccaaaaagaaaaggagcgattctacttgaatacagcagacatgcttacgacgtatctcagcaaactcccgaatctgatcattgcactgctcgtcctgcttatcggctggggcattgccaaaatcattgaaaaagccgtatacaaaggcctgcaaaaaacaaaaatcgacgacaggctgttcgccgaaaaaaagccggcgcgctattcctcagaaaaagtcatcagtaaagtcatttattttatcgcattaatcatcgtttttattctattctttaacattctgcatctgacaaccgtggcttcgccttttgtcagcatgctgtcggcgataacggcggctgtgccgagcgttttaaaagccggcttgattctgctcgtgggctgggcggccgcttcgcttttcagctatctcgtcaaaaaagcgggcatgaaactcgctgaaaacggccggctcagaaaatggacaatggtgtctgaagaagcggagatgagcagatccgttacggccgcttcacgaatcgttttttacttcgtcttgctcttgttcctgcccggcgtcttgtccgctctccagatcagcggagtgtcagggccgtttacaaatatgattcaaagcgttttgtcctttataccgaaattattcgccgcggcgctgattgttttaatcggctggcttgttgcccgtctcgtccgtgatatcgtcacaaactttctggcgagtatcggaacggaaaggctcgccgcacgtatggggctttctatttatctgaaggatacgagcctgtcggcaatcatcggaacgattgtctacgtgctgattttcattccggtgatcatctctgcgcttgaccggcttgatgtggcgggtatttctgaaccggcgtcagccatgctgcacacggtcttcacaatgctccctaatatcatcatcggtattgtgctgatcatcgccggcatctgggtcggaaaatgggtcagcagcattgtatccgggctcctgcaccgggccggtttcgactctcttctcggtaaaatgggctttgaacaggcgggcaccccgaagctgacgctttctcagacggtcggcatgattgttcagatcatcatcgtcctgctctttacggcagaggcgctgcagcttgttcatctcgaatttctcgtcgttatcgcaaccggtattatcgcttacctgcctaatgttctggccgctgtatttattctcggaatcggacttttggccggacagcttgtcagcaggctgcttgccggcatgctgagcggaaaggaattcagattcctggcgccgcttgcgaaatataccattatcactctctcaatctttatggcgctggatcagctcggtgtcgccgacacgatcgtaaatgccgcgtttattctgattctgggcggtttcgcgcttgccttcggactttcattcggtcttggcggaaaagaatttgcctcccgttatctcgcaaaattggatcgcaaaattgaaaaacatcaatcggctgacgatcgtaagccgccgatgtcttaacgaaaaaaacgtgtgctcagaaggagcgcacgttttttttgagttaagggggcaaattccttttttttcattttagattcatatatgatagactgtaacagaagcaaaatctcttttttcgaggtcattctatgaaattaacgaactataccgattactctttacgcgttttgatttttttggcttccagacattccgacgaactttccaacataaaagaaatcgcagatacttattccatctctaaaaaccacctcatgaaagtcatttaccgtctcggccagctcggatatgtcgaaacgatccggggccggggaggcggaattcgattaggaatgacaccggaagacataaacattggagaagtcgttcgacatacagaagacgactttaacatcgtagaatgctttgactccaaaaaaaatctctgtatcatatctcccgcctgcaacttaaagaaccttctgaatgaagccctgcaagcttacctggccgttttagacaaatatacgttaagggatctggtcaaaaacaaagaggagattatgagactgctcagaagctgaaggaatgtccgcattccttctttttttatgccggcataagaaaaaaggactatttctattaatatgataaacgattgcagacaagtgccgatataaagattatcattactgatatcctcaccttgcggctgcaacgaatggggatagaaaaattatcgcaggaaaagggagattcactatgaaaaaaaaggtagcggtcggtttgactgcatctgcgatcgtcgggtctgcgttagctgtaacaccggcagaagcacaaacgattaaggtcaaaagcggagattcattatggaagcttgcccaaaactacaatacaagcgtggatgccattacatcagcgaatcatctaaaatccaccgttctttctatcgggcagacgctcaacattcctaacggcaaatcagattccggcagcaaaaagccatcttcaaagaacagcggcacgactaaaagcgtctatacagtgaaaagcggagactcgctgtggctgatcgcatctgattttaaaatgtccgtacaggaactgaaaaaattgaacggtctgacaagcgacttaatccgcgccggacagaagctgcaagtgacggggaaagtttcctcaagcaccgatcagaaaaaaaccgctcctggcagcagctcaaacagcagcaaaaagcagtcatcatcttccgggacctataaagtaaaactcggcgattcactatggaaaatcgcaaacagcgtcaatatgaccattgcggaactcaaagtattaaacaacttaaaaacggatacgatctacgtaaaccaagtcctgaaaacaaaaggaacgtcttcttcgggaaacacgccgtcaaaagacaattcaaaccaaaatcaaaaccagacgcaaacgtcctcctatacagtaaaaagcggagactcactctggaaaatcgcaaacgcatacaatatgacggttcagcaaatcagaagcatcaacaaactgacgtcagacatgctgcgggtcggacaagtgctgaagctgaccaaaacgtcttcttccggctcttcgtcttcaccgtcagctccgaaccagtccggaaatacagggaaaaccactacatataccgtgaaaagcggggattctttatgggtgatcgcccaaaagttcaatgtgacagcccagcagatccgcgagaaaaacaatctgaaaacagatgttcttcaaatcggacagaaactgacgattaccgggcagcagacaaacacgacaccgaatcagtccggcagcacaggcggcacaggttcaacaagcgcgaagattaatgtaatgatcgatgccgcaaaagctcagctgggcgtaccgtatgtatggggcggaacgacgccgagaggctttgactgcagcggtttcatttattacgttctcaataaggtcacttctgtatccagactttcagccgcaggctactggaatacaatgacatcagtcagccagccggcggtcggtgactttgtctttttctcaacttataaagccggaccttcccacgtcggtatttatctcgggaacggccagtttattaatgccaacgattcgggagtcgttatttccagcatgaacaattcctattggaaacagcgctacctcggcgcaaaacgtttcttctgatacctgataagctgtacggccgcataaggctgtgcagcttttttacagtctgaaaatattgatgctgatcacgtgttttgttacgggatggaaatacacttcagcacgggatgaaaacgtttcttttgcggtttgcaccgttacgcgaaacacgtctttcgtctgttcccggttcacttttgtacggcccatgtacgaataatcggtaagctcggcccccttgtattcacgttcaagctggttccatgcgagctgttcccatttttcaactgacggatcgaggtgttctgtatgccctttttcagcgatagaggcaatgagaatgccgcaaaacaagagggcaagcgcaaatggaagggatttcatctttatgttctcctgagtcgttttttgtcaatcttagcgtgtccaaagaagagacggatatgcggttttattttatgtctccctcatattgctatgccgcagtgataaggacaccaagttttcccccgttgcatccgggcttcggcggcataaactaacggagaacttctcattgaaaggagaagcgtaagatggatcatgccgattatgataaagccttgtattacacacaccggtctcaatgggacaatttattaattttgatggttcgtacaaaagatgatttattatcaaagcgtattgagcactttctacacgcgtatcatttcgaatatgatcatgccgtgcttgaaaaagagctgtattcccttctcgggtatattgatcatgcgacagagctcgcttatgaagatcaattagccatgctgacataaaacaatcccggcgtcagacgccgggatttcttgtgtttgtgaacatattcagctcttcgatcatgtctttcaggctgaccgccatatcctcagatacggtccggcgctccatgtcgatgtgaatcgggtctaagaccagctgtttcgggatgacatttgcatagacgccccgcatgaccgtccgcatattcgccagcgcattcatgcctccttttcctccgcccgccgcggcaatgacggccaccggtttgtatgcccagtgatcgctgcttaaaaaatcgatggcgttttttaaagcgccgctcatgccgctgtgatactcgggagataataagacgacggccgctgactttttcacctgccgccttaacttttgcactgaaggcagctcgttctgttcttcttcaccgttataaagcggcagttcactttcgctcaaatcaataaaatcggtatgaaaccgatctctgatataagaagcggcaattctcgtccgcccgttttttctcggtgtgccgctgatcactaatatgctcatgattttaccgcctttcccaaaacattatattttaccgcatacaatgccgcctgcgtccgatcggaaagattcagctttgacagcaggttggacacgtgggtcttcactgttttttctgaaataaacagggccgccgcaatttccttattgctttttcctttggctatttcttgaagaacatctttttcacgggggatcagctgataatatttttccttatcctgatcatcctgaaccatatgggtcagcacgtgaggcacaatatccgaacttccggccgccgtcctcaagcggtacggtcgcatgatgggtaatgccctccgtatcgcggcagttcgtcgtctgttccgcaaattcaatccgtttgcaattcattatgtttacggcctttgtcaatccgccattgctgaatttggtcagacaatagcattccccgctgcacatgagtgcattttcccgctgaccgagagcaggcggtaaataagcggatgcggcgagcgtataagacccgtccggctcaatcagaaaaatccaccctgtctgcagtccggtcaggctgagcagttcgcggagcactttatcaagcgcttcctttaaatcgtggttttggtttaaggtttccgcaatcgcttttaacgtttttaacgtttctaccgtcgttttcgtcaatttccctcactccggccaatcagaattatccatattatatcaattcttttctgtatattcctttgttttcagcatgaattttcctcatactttcggatgaggcgtataaaaaaaccgccggatgtcgcttccggcggtttgttgtttatttcgttttttccactatgccatccaccgttttcatgacggcttcagataatgcggcaagacgctgttcgctgtcttgtaaagaagtccccttcacggcgaaatagaacttcactttcggctccgttcctgatgggcgaaggcagaaccaagagccgtcttcaaggaaatatttcaggacatttgacttcggcagatcaatatcttcttcaagatgatcggcaaatacagtccgttttcccgttgaatagtcttcagcctgcgtgatttgttttccggccatctgcttcggcggatcgtttcggaatgaagtcaggatagcggaaatctgctctgctccctgtttcccttttaacgtcaatgacttcaagccttcacggtaatatccgtattctttaaaaatggacagcagcgcgtcataaagcgacatgccctgctttttataaaaggcgcatacctcgacggctaacagcgcagcctggatcgcgtctttgtcacgcgcgaaatcgccgattaagtagccgtagctttcttcatacccgaactggaacgtgtattggcctgatttttcatattctttgatcttttcaccgataaatttgaagcctgtcagcgtgtcaaccgtatctaatccgaacgatgaagcgacagcgcggcccaattcgctcgtgacaatcgttttcatgacgacaccgttttcaggaagggtgccctgttttttcttctcggaaagcaggtaatgcaataaaagcgcgcctgtctggtttcccgtcagcactgtgtacttgccttcgctgttttttacggcaatgccgagacggtcggcatccgggtccgtagcgacgagaatatcggcattttgttcttctccgagcttaatggcatattcgaatgccgcgtgctcttccggattcggcgatttgacggttgaaaaatccgggtccggcagctcttgctcctttacgacggtgacgtttttgtaaccgagtgcttcaagaccgcggcgcaccggtttatttgccgtgccgtgcagcggagtgaacacgacgctgacatccacttcatccgaaagctcgggatgtacggagatggaagtcagtttttcagtatacggtttatcaatttcttcaccgattattttaatcaaacctttttctttcagcgactgttcatcttcaacttgaatcgttaattcattttctatggcattcacttccgcaatgacgatgtccgcttctttcggcggcagctgtgcgccgtcatcgccatacactttatatccgttatattcaggcgggttatggctggccgtcacgacgatgccggcataagcgttcagctttctcaccgcaaaagacagctcaggcgtcgggcggagctcatcaaagacgtatgtttgaatgccttgggaagcaagggtttttgcagcttccatcgcaaactcaggagatttatgacgggagtcgtatgcgatcgcaacccctctttttttcgcgtcttccccctgtttcgcgatatacgccgcaagtccggcggatgctttgcggaccgtgtaaatgttcattctgttcgtacccggcccgatttctcctctcatgcctcctgttccgaactcaagatttttgtagaaaaaatcttccagcagctgctcgtttccttctgcgtccgccaataattttttcaattctgaatctaattgttcggcctgattccagcgttcgtaactcttactccaactcatgttcgtcctcctataatttcagcttatgaccatattttaatatgaagcggctgcccgtgtcacttgataacttaaccaaatgctttatgtaaaaagataaaagaagggctcatgccttttcggcacagccctccggttattattgttcgagcggaacaaccgcgtcgtgcagcagcgtatttaaccactcagtgtgtttttctttcgtttcgtcattccattggaatcggtcgctcatgtaatcaatcacggccgttttatacgtttgcacccatttgatgtcgaagaacagtcttcccgttctgcggacgaagaaatcggcaggtgtcgcagccatttcttcttcgatgctgtaagccgcttccgccagaatgtgaaccggaatctcgcgtttttccgcttcatctttcaggccttcaatccggctgaatacattttcaacgttagagccgtatctgatggctaactgcttagcggtttcctgtgataaaccgattttcaagccgtcttttgtctttgcttccacaaatgactcgaagtttttagagccgccgacatgtccgccggaaatcggcatcgtcttcgtcttgcagccgccgaagtcctggccgccctcttctttcaagcggtcgcggacaagatcgacaatgtgctcagccattttacggtagcccgtcagttttcctccggcgatcgtaatcaggcctgattgagatgtccagatttcatctttacgggagatctcagacgggtctttcccttcttcgtgaataagcggtctgaggccggcccagcttgattcaatatcgtccgccgtaatgttcagttccgggaacatataattgatggagctgacgacataatcgcgatcctgcaccgtcatgcgcgggtgctcaagtttttgtttgtaaaccgtatcggtcgtacccacgtatgtttttccttcacgcggaatggcgaacaccatccggccgtccggcgtatcaaagtacaccgcctgtttaagcgggaatacggattggtcgaatacgagatggaccccttttgtgtgctggagatgttttccgcttttgctgtggtctttttctctcagttcgtcgacccacggacctgtcgcattgacgatttttttggcgtacactttgtattccttgcctgacagcagatcttcaattaaaacgccgacaacttttcctttttcataaagcagttctttcactttagaatagttgacaggctcagcaccgaatttaacggcttctttcatgacttcaatcgtcagtctcgcatcgtccgtccggtactctacataatagcctccgccttttaagccgtcttttttgacgagcggctctttttgcagcgtttctttagcagacagcatgcttctgcgctctgatttttttactcccgctaaatagtcatacacacgcaggccgattgaagtagagaatgaaccgaacgtgccgcctttatgaaacggcagcagcatccattccggcgtcgtgacgtgcgggccgttttcgtacacgatggcgcgttccttaccgacttcagccaccattttgacttcaaattgcttcagataacgcaaaccgccgtggacaagctttgtggatcggcttgatgtgccggccgcgaaatcctgcatttcgctcaaagcgactttcattccccttgaagcagcgtcaagcgccgtaccggcacccgtaatacctccgcctataataaacagatcgtatgtttttttagtcatgtcttccagcatatgatcccgttccaaacttgaaaattggtgattcatcattacgcttcctccttgttgtcacggtatagaaaaagagaccacaacagccaaagcgcatgtcatcactttggtgctgtggtctctcctcatctcaggaccgttcctattaacttgttttcagtataccataattttatcttatttaaaagccatagctgcatttactgcttttttccatccgccgtacaattcaacgcgtttttcatcttccatttccggtttgaattgcttatcaaggttccactgatcggcgatttcagtgctgtccttccagtagccgacagcgattccggctaaatacgcggcaccgagcgcagtcgtttcattaatttccggacgttcgaccggcacatcaagcaagtcgctctggaactgcatgaggaagttattttttaccgctccgccgtctacacgcaatgtttttaaagagatgcctgaatcagcctccatggcatcaagcacatctttcgcctgatatgcgagagattcaagcgtggcacggataaaatgctccttcgtcgttccgcgtgtcaggccgaaaactgagccgcgcacgtcactgtcccagtacggtgtgcccaatccgacgaaagcgggcacgacataaacaccgtcagcggaatccacacgctctgcgtatgtctcgctttctttcgaatcctggaacatccgcatgccgtctctcagccattggatggcagaacctgcgacaaagatgcttccttccagcgcatactcgacttttccgtctaatccccaggcgattgtcgtcagaaggccgtgatcagaagtgatggctttttctccggtattcatcagcataaagcagcctgtgccgtatgtgtttttccccatgccttcttcaaagcacgcctgaccgaacagcgcagactgctggtctccggccgctcccgcaatcggaatatttttaccgaagaaatgataatcaaccgttttcgcgtacacatgagaagacggtttcacttccggcagcatggatttcggcacgcctaaaatatcaagcagctcgtcatcccattttaattcatgaatattaaacatcagcgttcttgaagcgttggaataatccgttacgtgcgccgcgcctccggacattttccagatgagccatgaatcaatcgttccgaacagaagatttccgttttccgctttttcccgcgcgccttctacattgtcaagaatccatttgactttcgttcctgagaaataagggtcgatcaaaagtcccgttttttctctgaatgtatcattatatcctttttcacgaagctcttcgcaaatgccggatgtttgtctcgattgccacacaatcgcattgtataccggctttccggtatctttatcccatacgaccgtcgtttccctttggttcgtgatgccgatgccggcaatttgatcagcgctgattccggactcggaaatcacagtcgcgataacggcgagcaccgatccccagatttcgttcgcattgtgctccacccagcccggctgagggaaatgctgtgtgaattccttttgagcggaatgcacgatttttccttctttattaaaaagaatcgctcttgaacttgttgtgccttggtcaattgataaaatataggtctccatgatgccgctctcctttttaaatatattcagaatttgataatgttttctgtgattgagatttcttggtataaatatagagtatgaaaagcactacaaccattataacgcttacaaaccaaaagctaggtgtcacatttcctttaaacgcggcattgtaaaatacgccgccgaacgcaccgcccatgatcggaccgattacgggaatccaggcatatttccaatttgacggcccttttttcgggatcggcagaaaggcgtgagcgattctcggccccaaatcccgcgcagggttgatcgcatatccggtcgtccctccaagagaaatcccgatggcaacgatgaggaatccgacaatcagcgggttcagcccttttgtaaattcattcgctccgattgccaaaatgccgagcacaagcacaaacgtaccaatgacttcacttatcatattcccaaatgtatggggaatactcgggccggtcgagaaaacgcccagtttagcggccggatcatccgtcgccttccaatgcggcagataatgaaggtacacaacaaccgcaccgatcattgctccgatcatctgtcccgcaatataaacagggacgtctttccaaggaaagctgccttcaagcgcaaggcctatcgttaaagccggattcaagtgagcgccgctgatgctgccgacggcatatgccgccatggctactcccaatccccagccgaatacaataacaatccatccggattggtatgaaagcgatttctttaagttgactcccgcacaaacgccgccgccgaaaataacaagcagcattgtaccgattacttctccccaaaatgctgtcatcatcattcctcctaaatgacaaaatagcaggtttgacagagttatagagaataaaaaacccacaacaaaccgctttacgctttattgcttccgtaaagagctgttgtgggtctccgggtctccatcacatagtattaacctaggtctattgtaacaatgggtgtaagcggtgtcaatctttttttgtcatagaatgttcatatttagcccatagttcggtgtctgaagtcgtcacggccgtggctcctgcctgcaaggcgttttcaacgtcctgctccgtgcggatgaagccgccggcaaaaatcggaatccccgtcatttctttaatttctctgattaaagtcggaacgatgcccgggagaacctcgataaagtcaggcttatgctttccgacgaattccatgcttttttccatggcgctcgtatccaagagaaacagacgctggatcgcgtatattttcttttgtttcgctttgacgatgacggcggatctcgtcgaaatgatgcccgcgggccggatgtcctgacaaatgaactccgcaccgtattcgtcatgcttaatgccgtgaattaaatcgacgtgaaccatcagaagttttccgtgttttttcgcttcattcacgacaccttttaattgaccgaggtgtatatctaaaatgacgccgtataagaacggactctctaaaaatgcatcgaattgcttcatgttccggatagccggtagaatcttctggttgtgaaaactcatgttttactcctttactttaaaaatcaatgctcagcacgctttccttgacggtcgaaatgatgaaagagagctcctcgtcggacaggcaaaaaggcggtgacagctgaatgacattattatatcccgctacagtatcaccatttttcccgacaagcaggcctttttctctgcacgcggtgatgacgtgctgcacaagagcggcatcagcgggttccttcgtgattttgtccttgacgagctcaatgccggcaagaaggcctttgccccgtacatcgccgaccgccggatgttctttgagcggctcaagctcacggagcagccgttctccaagctcccgggagcgggcgatcagattttcgtcctccatcaattgcaggtttttcaaagcaagggcgcaggctgccggattgcctccgaatgtattcacgtgccggaagcggccgtacggctcaccgcccgaatacgcctcaaaaatctcccgttttactgccgttgccgacagcggcagataagcgctcgtaatgccttttgccattgtgacgatgtccggtgaaacgccgtaatgctgaaatccgaacggctctcccgtgcggccgaaaccgcaaatgacttcatcactgatcagaagcgcgccgtggcggcggcaaatgtcctctacctttgccatatacccgtccgggggcatcagtatccctccgcctgtaataatcggttccataataacgccggcaatcgtttcgcttaactcccacgtcatgatccggtcgatttcatgcgcgctttccaatgtgacggcatcgccgggattccgataaagatcaggcggcgccgcgtgcaaaaaaccttgtgagagcggctcatatttatattttctctgcgcctggccggtagcggcgagcgcccccatcgtattgccgtgatagcctctgtaccgggagatgaatttgaagcggctgtgatcgccgttttcaatgtggtattggcgggcaattttgaacgcggtttcatttgcttccgatccgctgttggaaaagaagattacataatcgccgccgagccattcattcagtttttccgcaagctcaatcgcgggttgatggctttgggtcagcggataataaggaagctccttcaattggctgtaagccgcatcggcaagctcctttctcccgtatccgatattgacgcaccacaatcctgacatgccgtccaaataccgtctgccgtcaatgtccgtaacccaggcgccttcccctttttggacgattatgctgtcatccggctccgcccctttcatcgcgtgccaaatcagctctttatccttttgtttgagtgactgatttttttgtacatgttccacaccgctcatctccctttcaatatcattgcactgtatcgaaagctgcccggcttctgacgccgattctcatggtgaagttttcctcttaataagaatataaaggcgcggcatgggcgagtcaataaagcggcggcaattaaaaaaacgctttctcccagaaagcgaaagggctacaagagcatatcccgaaaccggggccggtgcaagtgtttttataaaaaaacccgcccttaagcggggcgggcgtttttttatttcagatgcgtaatccggtaaatgtctttgcgccggtctttcagctggcgcacggttccgttttcacgctgccttcttaagatttcaaggtccacgtccccgatcacgaccatttcgatattcggattcgtttcaccgacgattccgtctctggcgaattcaaaatcagacggagcaaaaatggctgactgcgcgtattgaatatccatattttctgtttgcggcaggtttccgaccgtacctgagatgacggtgtaaatttggttttcaaccgctctcgcctgagagcagtaccttacgcgcaaatagccttggcggtcttcagtgcagaatggcgtaaagataattttcgccccttgatccgcggcaattctcgcaagctccggaaattcgatatcgtaacagatctgaatggcgatctttccgcagtccgtatcaaatacgcgcaccctgtctccggcgctgatgccccaccatttccgctcattcggcgtaatgtgaagcttatattgtttttcaatcgtgccgtcacgtctgaataagtaggcgatgttataaattttcccctcttcttcaacgaagtgggagccgccgataatgttcacattatatttcaccgcgagatctgtaaagaggctgatatagtcctcggtatattcggtaatcctctgaatggccagactcggagaacgctcttcgagaaatgacataagctgcgtcgtgaaaatctccgggaataccgcgaaatcagatctcgcatctgaagccacatcgacataatattcaacctgattggcaaattcctcgaaagaataaatctttttcatttcatattgaatgacgcagatgcgcaccggaaatgccgatttgtaatagcgctttgactgcggcagataatcgacattgttccattccattaatgtcgcatatttaatggacgcggtgtcatccgggagataattcggattgatccgcatgagcgtaaatccgttcatcagctggaaagaaagcaccgggtcataaatctgatggcgcgtcacctgttcgacataggctctcgccgtcatttcttccgcatacttatgataattcggaatccgcccgccgataatgatgcttttcagattcaatcgtctcgccaagtcttttctcgcctcatacagccggtgtccgattttcatccgcctgtattccgggtgaaccattacctcaatcccgtacagattcaatccgtccgggttgtggttcgtgatataaccgtcgtctgtaatgtcctgccacgtgtggcggtcatcatattcatcgaaattgatgatcaggcttgagcatgaaccgataatttccccttcatactcggcgcaaaactgaccttccggaaagtgcgcgagatggctgattaaatgctcaggctcccacggctccatccccggaaaacaatccttttgcagctcaataattttgttgatatctttctcttccatattccgtatgaccattttcttttcaaaacgggtcagatcaagtttctcagacaatgctgcttccccctgccggttcgttttgatcgttcaatcgctgtaagagtaattcaagttccatttccgccatcgattccagtctgtgatcgtattcttcaaataacagggcgctcgttaccttattcggcacgatgacacatttcatgccggcgcgtttggctgcgattgagccgttgaccgaatcctcaaaggcaagacattcagaaggttcaacgcctaaatgttccgcagctttcagatagagcttcggattgggcttcacttcttctacgtcgtcagccgtctgaatcacttcaaattcatcaaacaggcctaattccttcagatggcccgacacccatttaaaatctgagctggaagcgagccccaccttcaatcctaattcttttgccgcggctaaataagcctccactccgggacgcgccgtttccgtcttcatccgctgttcgaagcgcccgcgcctgatcgccgtcagttcatcatgatcgagctttcttcccagctgctcctctaaatatgcgaacggcttaaaccccgccgccgttccgatcacctttccccagacggataaaggcaatgttgaaccgtgttcctcaaacatttcctgcagcacttcatattcatgggtttctgtatctaaaattaacccgtcaaaatcaaagattaatgcttttatcaatggttacagctcctttagctaaacgtactgacctatgtatacactataccgtgaatttcttttgcattcaaaatgtaacattctcacggaaagaagagcctgcatgagtgcaagctctcttcatccgttactgtgtgttttgactggaaatattggaaagagccgctcccgcagactcatttgaacgctgatcgaccgctaagtctccaagcgcaacgatcccgaccagatgattttgatcgacaatgggaaggcggcggatttggtgttgggccatcagatgtgacgcctcttcaagactcatttccgggtttccggatacaacttgagaagacatcacgtgtgaaacaggtgtttggccgtcgcggccttgagccgttgttctcaatgcgatatcacggtctgtcagcattccttttaattcccctccgtcaacgacgggaattgctccgacattatgctggtgcatcagcgcagccgcttcctggatcgtttggttgggagaaacggtagccacgtgggtagtcattgattgtttgattgaactcattgtaaagcacccctttcgcattttattatgctcggggatttgactcattataaagggagttagaggaaagaaattgtggtatcatgtcaaggaagcaaaaaagagcctgtcaaaaggctctttatacccgtcagatcagccttctgtgaccgcaggcttctgatccggcccctgtctcgaaatcatcataggtaaagggaaaattcattccgcattcattcagcaaagcgcaatttttatcaaacagcgcccgctctttgacgtcatatacggggtgcggctttgacagcatgatatgtaccgtttgcagacaagccataatttgaaacgcttcttttaaagttccttggtaacgttggttttgtaaagacaatacgcccctttttttaaagcgctgaatttccagttcggagaaataaagaggaaagacattttgaaacaattcagaggaaagctcttgtatcgcgctttcttgtccgtcagtcgctgcgttcacaattctcacatcaatcacctttcttgccatgtgaatatccttaatctttatcaagaatagcatagaaaaaaacgcgaaagctaaggtaagtgtttcctattgaaacagccgctttccgcttgaaaaggagctttatgatatgaaacaaaatgaccgcggtctggaactcctgattacggaaaaacacgccggacaatggctgttttcagtcctgaaatctgaattccaggcgtcaaaacccgtgataacggaatggatgaaccaaaaaagcattcaggtgaatcggacatccccgaaaaacaacatcatactgaaaaccggagaccgcttattcattgatcttcaggaaaaaacgggttcttcggtaattcctgaatacggagagccggacattttatttgaggacagtcatatgctgattgcaaataagccggcgggaatgccgactcatccaaatgaagagggtcagaccggaaccctcagcaacctgatcgcttaccattttcaaatcaacggcgaacaagcgaaagtgcgccacgttcaccgtcttgaccgtgacacgtcaggcgcggtcgttttcgcgaaacaccgcctggcccatgcaatccttgaccgtcagctcgaaaccaaaacattaaaacgcacctatatcgccgcggcggaaggaaaagtcacgccgaaaaaaggcacggttgactcgccgatcggccgcgacaggtcacattccgtcagacggcgcgtctcacccggcggacaagccgccgtcacccattacaaagtgaagggctatcatcccggtgcgcagcttacattggcagagcttgaactggaaaccgggagaacacatcaaatcagggtgcatatggcaagcatcggccatccgttggcgggcgatgacctgtacggcggaagcagggcgctgtttcacaggcaggcgcttcacgccaaaaaagtcagtgtcgtccatccgatctcaggagaagaaatcgttgccgaggcgccgatgccggctgatctggctcattttaccgaaacgtatttttcttaaaccgggtcggcatatataatatatcgtttcggcgcatttccaatgtaagaaaacggatagcaagtggtcaggatcagttcctcccgcttgtgttgaagggtgatgacagacgtatcatcccggctgacgatttttgtacggctgattttataagaaaacgtgccgtaagacaaaatcacgttcagtctgtctccttttttcagttcgccggtccggcggaacaccgtgtccctgtggccggataacacaatttggccgtgatcgccaggataatagctgtccttataatgtccgacgccttttgctaaatcatctgcgtcagtcccttcgacgatcgggagctcagcgtcaatttcagggatttctaaaatgccgcttgcctcacccgtttcggggtgaaattcttttttgcgctgtgcctgcacagcgctttttgtttcgttcttttccaagacaggttctgttgctttttttgcttcttcaagcgattggttcgttttcatatgtgaatcaatgatcttccagcttccgtaacatgtgatgataacacctgcgatgatgacgagaagcggaatatgtttcagtttgttcatcgtgtgcgggttccccttttctttctgaaaagccaatatacgccggcacccgtgatcaccaggccggccaatgccgtctgatggctgcccgctgaagtatcaggcaatgggcggcctttttgtgtgccgctttcagtctgttctgtgctttgttccgaatctgcggcagacgccgtacgggattcgggaattgactgcactgtatcagatgctgcttcttttacgacaggacgttcaggttttttggtttgatcaggctgttctgctgcatccggttttttagcgggtttttccgtttgaggtttttctcctttatcaggcccggtgctgcccggtgtttccccgcttcccggctgattgccggtgtcatcaggtgtttcggcggctgatgccgtgcggatgcggccgtcggtttgataagaaatcggtgcggaaaagcttttgacatagtctactgtcgcttccaaatcctcaggccccgtcaccggattcttgccgagtttcccgatcggaccgtattttgcccccgctgccgtcgccataaattgattgactgttactgtatatcctttttcgggctgtatgtctgtaccgtccgccattttcacatccgccgcttgtccggtttccgggttccatgtataggaaaatccgctgatgctgtaatccggtccgtacaccggagaaatttgcgcgttgatgatctcccgcaaatcttttcctttgatttcaagcttcgtcagcacattgccgaacggctgtacattataaagatctccccatgtgatcggccctttttttatgccgtcccggatgcctcccccattcataagcgcaaaatcggatttcatcttcgctttcataccgtcggcaatcagatttccgagcgccgtgtcgccgtcatttgaatacccgcccgttatatcatgggccgcttccccgaccgcttcgctgataatcggtttcactttctcttcatatttgcttaatatgcctgccgcatccggatcaggcttgattttactttgatcgatatattggatttccgctgattttttcacgatatccttcgactctttatctagttcgagatcggcgattccgattgcttttccgtattcaaatgcctgcacgatcagcttgccgttgatttctccgtttacgactttatgattgtgcgcggcgaaaatcacgtcaatctctgagtctgttccgcttgcaagctttgcggattctcccgtgatggctgagccattttgttcagcagacatatgggcgagcacggcgattgctttaattccttttttcttcaggtctgcggcggcgtcattgacggcctttacctcatccgtaaacgtaatatttttaattccgtccgggatgaccatgcctgccgccgatctggttacaaccccgataaatgcgaccggaattccggaaacgtatttgatttcatacggcggcagaaaggactcccctgacttcaatttacagttggcgcagacgagcgggaaatcttggccgtcataaccgcttgtccccttaccgtccggatgatctcctccattgatgatccgtttaagctcattcgttccttcatcgaattcgtgattgccgacagttccgacatcaaaaccgatgtcttccatcaattctactgtcggttcatcctgaaaaagggctgacacgggagagctgcccccgatcatatcgcccgcatgcacgacaaaggcgtgttctttctcggctttcgcctttttaatgtacgcggtggcgtagtccatccgtccgaaagtgccatccggtttaccgtctccgttaaggtcaagctcatattgctgatcaatttttccgtgcagatcattcatgctgatgattctgagcgggatacggccggagtcttcagtctgccgttctttatacgctttatccgttccagcttcattcagtgatccggcttgtccgattgcttccgcatctttcacgctgaacatcataaaacaaaccgtcagcaaacagcacgaaagacgcaaacccctttttttcttcattcatttcccccctgtcttctaagaaatacgttagcttattttcttaaaaatcacatcacttttttgtaaagattgtcttcgctggcgcaaaatagtaaataatccccacgtaacgaaataagtcttgatgtataacggatcggcttttttcacatcttaaatgtgatttgacatgaaggaggaaaacaaccagtggaacagcagcagaatcagcagcagccgccagtaaatcaggggattccgggttcaccgcaagtgaatcacggaggacatgagcttttcgatatgcatgaagtgctggccggaacagtcggcgttttggatcaatttatgatgctcagacagtttatacaggatcagcagctggccgacattcttgaccgccagtatcaattcattctcggactctataatctgacggcagaatgctttaagaccggccaaaagccttctcaggaaacgtcgacatatatgatggaggaacagaaccaggccgtctacggtataaaaccgactcagccgaaaaaaccgaatcaatcattaaatgatgtcaaagatctcggaataagcggccatatgctcggcctgattaaagctcaagcttctctcttgacgatgagctcgcttgaaatgaccaatcccgtcacaagaagagtgctctccgcccaaattcagcaatatgtcgaaatggcgtatgaaatcttcttataccaaaacaaacacggttattatcaggttcctcagctcaatgcacaagatatgcagaccatgctgaattcatttgcgccggcgcagggacagccgcaaatgcctccgattaaaggacaaatgggacagcagcagcaaaacctccattaatgaaaaaaacggcgttggaaagctgactctccaatgccgttttctttttttcatatgcttttgtgaaatcatgttcaaattgtttcaggctttctttcgtagctgcttcaaagcctttttcaaaatcctgtgtttcggcggttttattgataatggttaagataatgccttctccgaatgtttcggttaaatcctttatcatatagaaactttgcaaataaacatccgtttcatattccatacgcgatttctgccattttcggtcggtcgttaattgatcaaacggcacgacggaaaatgcaatcggatcaatgaccacatcataatgcgcaacccactcgctcagcccctcatgaaaccaaagcggaaatacagacgtatccgtccccaattgccgcgctttttgatgaaatgcgtagtgtgtatattcatgtataatcaattgcttatacatgaaaacggccagctcatcttttttcaaaagctgttttttctcttctggcaagagccccatcatctgctcctgctctgaataaaaaccgactacatttttcaatcctgagtattgctccatttcagcttcatccgaaaagaaaatgagttcaagaggcgccgctcctttatagccgacaatgatttggttgatacgctttgcgtggtccagcgtaagcttggtcagatccaagagcggcttttcatccgctgtatagtaaatcgctgtatgtttgtaaatttctttattcatgtgttcagtcacttgttccttcgtcggaacagagcggctgttttggcctgacaggacgtacatcatacttactgaaacggctgaactgacagccaatatgacaaggactccgcacaggatcagagtgaatgccgcccgtttccccatgccgtcacgcaaacaagctcccctccccgatcctttaattttcatctcattctttactttatgctcagaagcgctgggtcgtgacggcagataaaataaaaaagccgcagcaaatgcggcttttccattcatttatttattggggtttgggaatacacgctgcaccatttggccgaattcatcaaacagtccggataccgggtggccgttttggattcgttttccgtagccttgcatacgttcaacgaagtccgggtttgctgatacatatacagtccggacatgtttatcggctgatttcaccttatcggtaatcttatttttcaaatggttggcgatggcgcctttttgtccgtttgtcagaacaacggctacataagcgctgtttccggcaacgatcacagtcgcatttttaacttcttttaaatcagtcaccttgtctgcggctttatcagccactctcaggttacggttgtcattgtgatcggtgttttggttatgacggttcactgtattcatatttgtcgcaccgtcgttaggtgtgttgcggtaatttacattctgggtgcggttgtcatttcgttttccttctccctggttccccatactgcaccctgcggtaatcagcatcggcagaagaagggcagaaataactgcttgtttttttatcatgtgaattcctcctttctcactttacgtataggtttttctattcggcgggatttatgcacgccgtttgcattctgagcggtttggataaatatcagaaggatagggaaaggtaagcgtaatcaattgaatgaggagggatttaacttgttcagacaaaaaagcggcatcagcccgacagcgctgctgatcggatcatcgattctgattgcagctttatcacccgaaatccgccggaaaatctccggaatggtttcaggccgaatgcagcataaagatggtacacactccatgcagcctgctgacctgattcaacaggctttcagcggggaatccggcggacagcagcacacggacaaagcacggcattcacaaacaggctccatgcagcctgccgagctgatcaaacaggctttcggcggggaatccggcggacagcagcacacggacaaagcacggcattcacaaacaggctccgtgcagcctgccgagctgatcaaacaggctttcggcggggaatccggcggacagcagcatgagcagacttcccgcaatcactccggctcatcccatacggacggacaggcagaccgcagtaaagaaacttcgccgaagcctcactataccgagccgattcacttcgaagaaagcgcggtaaatgttttaaatgacagcaccgtgatgaatatgctggaagaaattgaacccggaaatcattagaaacgaaaaaaatccttcattcgttcaacgatgaaggatttttcgttttagcgctatctgcttttttattaagcttcttcagcttcaatgacgattgaggaatcattgtacaccgcggtatcggtttccttcgtcattttacttgttaacagccctgcggtcatactgccgctgacatttaaggcggtacgccccatgtcaattaacggctcaattgaaatgagcagcccggcaagcgcgacaggcatgttcaaagcggataggacgagcagagccgcaaatgtcgcgccgccccccacgcctgctacaccgaatgaactgattgccacgatggcgatgacggagatgataaatcccggttcaaacgggttttgccctactgtcggcgcaatcatcatcgcgagcatcgccgggtaaatgccggcacagccgttttggccgatcgataaaccgaatgaaccggcgaagttcgcaattccttcagggacgcccatgcttttttgcgttttaatattaagcggcaaagcccctgcgcttgaacgggacgtaaacgcaaacaccatgacaggaaatgcttttttcacgtatgtgatcggatttaaaccgctgaacgtaatcagcagcaggtgaacgataaacatgacgataagcgcggcgtatgaagcgatcacaaacatccccagtttcgcaatgctgtcgatgtcgcttgtcgcgatcgtctttgtcataatcgccaataccccgtaaggcgtcaatcttaaaattaacgtcacgacgcgcataataatcgcgtataccgcatcgacaattccgctgaacgtcgcagcgtgctccggctgcttccgtttcacgcccagaaaagcgatgccgaggaaagcggcgaaaataacgactccgatggtggaagtcggtctggctcccgtgaaatcaagaaacggatttcccggcagaagctcaacgatttgctgaggcagcgttttggccgtcatatcctcagatttttgctgcagctcctggcctcttgataactcggtgcttccctggtcgatatggacggctttcagatcaaaagaaagcgccgaaacaattccgactgccgcggcaattgctgtcgtggcgatcaaaattccgatgatcagtccgctgattttcccgatgttatgggtcagtttcagcttcgtaaatgcgccgagaatagaaataaagactagcggcatgacgatcatctgaagcaatttgacataaccgccgccggcgatattaaaccaatcggccgtttgtgtcacgatatgtgatgccggcccgtaaatcaattgcagtgcaaaaccgaatacaatgcctagtccgagcgcggtaaagacacgtttagaaaaggaaacgtgttttttttgcatgacaaacagacctgctataagcaaaagcataataaaaacatgtaagactacaaataaattctccaaaacaggtaaacactcccttgctcattatcctttaacactatattatatcaattccgatcggtcaagtaaggattgacaatatatgtatttttattgatttttctcttttctttccaccctttctctagtaacttatataagggtgattgttatgctgaaggaactgtttcttaatttaacgattttaatcacatttaattatctgttcacccttctttttaaagagtcgctttcgtataaagaagaccgtccgatgtttcaattactgaaggggacggtctgcgggcttttaggggtttttctgattgctttcggcttttcttactccgattccatcattgatctcagaaatatccccattatcatcgccgctctttacggaggctgggtgtctacggcagccgcctttgcgattatcgtcgcaggccgtatcctgatcaatttcaatgcaagcgccattttttccatcgccgccgtcggggttattgcgatactttctgcggccgtcctcagaggaaaaaagccggatcataaaatggcgttcgttatgctgcttttttcaaatgttattttcaccttgacgctgctgtttcttatgcctgaacagcctgccggggccctcgtttattattggctcatttccatcttgggcggaatgctgtcactgtatatcatcaaacacgaagccgatgcccgcgttttgttcaagcaatacaagtttcaagcgaattatgattttctgacggggatttttaataagagaaaattcgaggaagtctcgcgcgttctgtacgatcggacgtctcaatccccctcgtctcagctcgcgcttatttatttggatattgatcactttaagcagatcaatgatcaatacggccattatgaaggggaccaagtgctgaaggaactgggggcgcgcctgaggttcttactcagcagttctcatacgtcagcccgcatcggcggggaagaatttgccgtgcttatgcccaattgcacgtatacaaaagggcttcacctcgcagaggaaatcaggcacacgattgacgcgaacccgattctgctgacgagcggagatacaattcccgtgaccgtttccctcggcatcgcgcattatccgacaaatacaccggaccctcagacattgcccctgatcgcggaccggatgctgtacaaagcgaaaacatcagggcgcaatcaagtgtgcagcactgaaaaaaaagaatgatcgcccgaagaggaaatcattctttcttttcagtgagaaagccgcccctcaggaaaacgggaatcaggctgccctcatattctttttcaatcaacgccgcggtatcatctgattgatacaaagacaggagtttttgcatccgttcatcatctttatcctcagctctgacggcgatcagatgaatatacgcttccttcatttgcgccgatcggatcagcgcgtccttctccgcatgaaatcctgcttttttcgcctcgctttgactgagaactgctgcgtcagcatgttccgccgcctgataggcgttcttttttgtttccgtttttaaggtcagatgcttcgggttgtccttgatcatatccgttgaccccgtaccgctgaatccctttttcaatgtaatcagtccggcctcctgcatgagaaaaagcgccctgccgaaggccgccgcttcatcaggcacggcaatgaccgctccgtccggtatatccttcagccgtttatgttgcttggaatacacccccagcgatgccgcatatgtcgttcctaaaggggccagcttctttttcacgtgaggcggcaaagatttaaaattagtaacggattgaaacgcattggcgtcgagatccccgccggcaagtgccaaatcggcctcagcataatccgaaaacgttaccaaagaaagctgcaatccttcctcaccggcttttttcgcgacaaactcccagatcgattgatcagattcattgattccgatagtaatggtccggttcccgtcaggataatcgcatgaagtaagtgacatgatcaaaatgaaaagaaacagactgtttataagccgcagattcaagttgacctactccctatctatttttatgtacagaagctgcaccatggtattcgggctcatgattacatacaataccgattaaaaaaagggttgtcaattgcttccttaagaggctgcaaagcggtttttatcagctgcaaatgggctgttctggtctcaaatcagatttccgtatcagagcgttttcctcttaaaacatgttatttcgaaaaaagttacatttagcagttgttttttcttcggattactggtagagtaaaggtaattatttttgttcgaactatctttaagaagaaagttttgtaagagttttcgtcttggaagtttgttttagagcaagaatagtgaatttaagcgtttgtcgctttaggaggaaatttcatgttagaaggtaaagtaaaatggttcaactctgaaaaaggattcggattcatcgaagtagaaggtcaagacgatgtattcgttcacttctctgctattcaaggcgaaggcttcaaaactttagaagaaggccaatctgtttctttcgaaatcgttgaaggaaaccgcggaccacaagctgctaacgtaacaaaagcataaattgtttaaaaaaacctgccggtgtacgccggcaggtttttttcatctaaaacgaaaagctgttttgcaaaggcaaaacagcttttttatatcaggtggcaatatcccgttttaagaagacgccgaatgcaagcgccagaaaaataacgaagtaaatcacaagcatcacaaccgaaaatgtcatcgtcatcccctctactaaaggagtcccgttcatatattgcgacaaatccgtgttcgcaaataaaatatatttggtccattcaaatttcgcagcaagaaataccgtcgccgtgttccccataaccaatagaaaaatagaaaatccgaccgctaatgaactgttccggaataccgcagacagcataaacgccatcgtcgcaagcataaaagcggagacagattcatagacatatgttttagcgaggaaagcgatgatattttgctcaaaaacatggccgtctttgtatacgagatgaacatcagccgcagtatctccgcctgtaccgaaaaagaccaatcccaacagagcggagccggcaaataaaatcacaagcatcagcagtccgaacagcagcactgtcatatatttagaaagcaaaatctgaaaacggctgagcggacggatggccagcagcttgatcgtcccccagttgaactcattcgccacgatgcctgcggcaatgataatcgtaaacagcccggtcaaaacagtcatcatcgaagaatcagatacgtatgaccacactgtgtaccctgtatcctcggggatgttatgatccatacggtattgatttatcgcgacattctgtttcaggttatcaatgagcgtctgatttccggtttccttcatctgctgtttcatttctttgttttcagcctggagctcctgtttccaattcggattggcttcgttcgaggtgaaatggtttgacagaagcgcaaaaccgatcatcgaaacgcctaaaatcacaatcatagcccacgtgccgacgcggctgaaaattttaatccattcattatagatcagcttaaacatattgaacctcctctttcgtcccgccggtaatttccaagaaacggtcttccaaagattttgtcatgattttcacttcatataagcggatgttttcacggacgagcagtgatatcacatcaggcacttcctgtttggacagctggatctcaatgccgtttgtcttcttcacacagtcaaactgactcaaaacggcaagagcctcttctctttgttcaatatggaagaagtatgtatctttatcctcttttccttcatcccttactttttgaatatcgacaagctctcctttttgcagaatgccgattcgatcgcacattagctccatttctgacagaagatggcttgagacgatgacagccattcctttttcacgtgtcagctttttcagatggtccctgatttctctgatgccggcgggatcgaggccgtttgtcggctcatccagaatcagcaccttaggattatgcagcaggctttgggcgaggccgagacgctgtctcattccgagagagtaggtttttactttgtcatgtattctgtcctgcaacccgacgagctcgatgacctcatctattttttctttcgtaacgccttttaccatccttgcgtactgctgtaaatttttatagccgctcaggaatttgtacagctccgggttttccacgatggctccgacgtgcctgaccgcttttgcatagtttttcgtaatggattccccgcagattacgatgtctcccttagacagtttcattaatccgaccatcattctgatcgtagtggttttccccgctccgttcggccctaaaaatccaaacacttcgcccgcccggacggagaagctcagatcatgaataatcgttcgtccttttatcgttttctttacctgttgcagttctaataccgtttccaattagaatcccccttctatttcgtgcgcctgcatgacgtttctataccattgcagcacggacattccttcctgttcccgaatttcttcgacctcgcgccgttcagcgattttcccttttatgaaaaccatcacttcgtctaacagcgtctcaatctcgccgatctcatgcgtggcgatgacgacgatctgactgtcaaaatcaatataagatacgagactgttgacaatcgactccctgaccgccggatcaagacctgaaaacggctcatccagcagaatgaccgatgcttttctcgacagggccaaaacgattttcagcctgccccggctgcctttggacagctcttttaacttctgcttcgctgaaagattcatttccgctaataggttatgtgctttttccagctgaaaatccgggaattgcgaatgataaaacgtgagcatatcaccgacggtcgtccgggcggaaaacatatcatgttcggttaaataagccgtacgaaacagcatgttcctgcttactttgcactctcccatccggacggcgcccgatgtcggaaaagcaagccctgcaagcattttaagcgttgttgatttaccgcttccgttcggccctaaaattccgtagattttacccggagacaatgaaaatgatacatcgctgaccgcgatcctgcggccgtatttttttgttacgcgttcaaaatcaagattcatcgtttgcttcctccgcatattgtttgatcccctcgagcatttcctcaggagataaccccagctccgccatttcctgaataaagcgtttgaaaacgtcttttgtcagcctgtctttcagctctgctttcagatcggatctttccgctataaaggttccctgtcctcttctcgtctccacgatccccagcctttccatttcactgtacgttctttgtatcgtgttcggattcactttcatctgtacggccatctcccttacggacggcagtttgtcccccggtgaaagctcacttcggatcagccggtaatatatacgatcggcaatctgcagataaatgggcttggatgactgaaattcattctccatcattacacctcaacctttcgattcagcagtatagaggccagcgcgagacagagcgctgcaagcacgatcactgccagaaagctgaaaagcgaaatgtggacggctttcagctccatcgtccatccggacaatttcgtataatgaaaatgaaaattcgcatacacttttaccggccataaatcatgttgagatgaagtgaaaggcgtaatgattttatcgtcaatataggtccagacaaacgcaagcacgatgcagatcccccaacggaggacgggaaaatgttttaatgagtgaaaaacagtccaaaatacggccacgatcacagataagtacgctgaactgatcagcaggtaagcattcagcccggttaatgtgccggccaggggaatggtgtgttccagcactccttttgcagaaagcatccggtacatccaaatgccgtaacccgtcagcgccagctgcccgatcaactgatacagcagtgaggccgtcagcttggaagccagcagataaaatcccccattcggattgtaaagccacagctggttttttccttctttatgaaggtgataatacataaaaagcggcgctacaagaaattgaaaaaaccccattgccgtaaaaaagccgaaaatgacgagcggttctttctgacgggcagcgatgacgtgggctgaaaacgcccagcaaatcatgccgcaaagccacaccgcgagccaaatccatgaaactttcgcatcttttttcagcaaacctaaaaacgatgtcattctttctctctccattcggatcaagtgtatgagtaacatagtacactagatcatcacgtattacaatatcttcaataaaaaaaagacaaatccgctcttacgcggatttgccttttcaattacttctttttgttttttaaggagagcagcgcatcacgatagctgctatcctgcattttgccgccgctatcaggatcgtttggttcctgatccgtctcagaagtcttaaacttctgaagcgcctgacggtacacatcatcgcccattgtattctttttctcacggggagattcagattttacaacgacgggagcatgctcggctgagcgctcctcggccggatcatgcttttccggctgttcggctgtagtgccgatcgcttctctcttttcttctttgacatcctgtcctgcagaagtgctgcggacattgaaggtgataagaagtgcaatcacaatgacagcagcaataaccgctataataatggccatataaccctctccttactgtcgtccggcagttagattaccagtgacctggctgacacgtctgccaagcgcacggcctaattgaaggccttcttccgtcatcagcacatcgctgtcaaccgggcatgtgacgcccgcgccgtagtaagagccgtacagcgcgttttcaggaacgttgccgggaagaccgacaacaatcatgccttggtgaaacataggagtgatcagattgtgcatggtcatttctaatccgccgtgtgttgtcgccgtcgtacagaatacagcgccgactttatcaatcagctcgccttcagcccacagatagccgagtctgtcgatccacgcttttaagcctgaactgatggtgccaaagtgtcccgggcatccccagataatggcatccatgtctttcagcttgcggatgtctgcttgatcgacatggtcgatcaggacttcagcctcagcgttttctcgtgcgccctcggcaatggcttcagcaagatgttttgtgtgttcgccttcactatcgtacactacgtaaattttcattcaggaaacctcccattcagatgattaagattccttcacttctttaggggccggaagcaatgacagctcctcttttttcttcgcccgctgtttgtctttccgcacgtcacgcaagaacagactcaggactacgccgataaccgcaaagatcgtcgcccacataaacgcgtcattaatccccataacgttggaattgagtgaagctgttttgtagagatatgaataaacggtttgtttcgccgcatcaagcgacatgttcatgttgaccattaaattcgaaaccgcgctttggaacgactgcatgaagcttggatcagccgtgcttgttttatccgcaatctgcgaataatgcattgtcgtacggttcgtataaatcgttgtgatcaaacttgttccgattgatccgctgatctggcggagcgtgttgctcatcgccgtgccgtggctgttcaaccgtgccggaagctggttcattccggctgtcataacaggcatcattaacagtgacataccgaatgcgcggatggcatagacaagcatgatgtgcgtgtaaggtgtgtcaattgtcaattttgtgtactggaatgtcgttgcgaccgtgatgaccagcccgataatcgcaagcggtctcggaccaattttgtcaaacagaataccggaaatcggcgacatgatcagcatgacaatcgcgcccggcaatagcaagagacccgattgcagcgccgtaaagccgactaagttctgcaggtaaatcggaagcaggaacattcctgtgtaaagcgcaacggtaataatgatattaatgacactggaaagtgagaaaatatcatatttaaatacccggaagtcaagcatcggtttttcagagcgcaattgctgaatgacaaacgcggcaatcgcgatgacaccgacaatgacggtagacagcacgatcggatctccccagccgtcgctgcccgcttcactgactccgtaaagcaatgaggcgaatccgacaatagatagaatcgcacccaagctgtcgagtttgattttttgcggttccaccaagttcttaaagaggaaaaacgctatgataataacgattgccccgatcggaacaaggccgtagaacataatgcgccatgtgtaatgctcgatgatccagccggatagagtcggtccgaccgccggagcaaacatcatcgcaagaccgaaaatccccattcctttccccctgctttcaggcgggaagataagcagaatggttgtcatgaccagcggctgcaggataccgccgccgaccgcctgaattaaccggccgatcagcatggttgagaagttaggcgcgattccgcagactaacgttcccgctgtaaaacagaacatggctacgagaaagaggcttctctgtccgaaccgggtgattaagaacgcagataacggaatcaaaacaccgttgaccagcatgtatccggtcgtaagccactgaatcgtcgtcgcactcacaccgaactcggtcattaagtgcggcatcgccacgttaagaagcgtttggttcaagatcgccaggaataacccggccataagcacaataagcaatgttttaggactttttacttgattatctgatttagccacctaagacaacctcccttcatggtttgatgactgatctgtattattcagagatttttacagatgcgttcataccaggaagcaccttgtcagatgggttgctgagtgaaattttaacaggaactttttgcgttactttagtgtagttgccgcttgagtttgaagaaggcagcatatcaaatgttgaatttgtcgcataaccgatttcttctactgttccgtcaaatgttgtattaggatcgccgtcaacaattacgtctactttgtttcctacttcaatgtctctaatgtctgtttctttaatgtttgcagtgatgtaaaggtgtttcatgtcaatttcctgggcaattgtcgtaccggcttgcaccatttggccgtttttcacttcgtttttcacgattgttccatccatgatggcttttacgtcagcattttgctgtcctttaatttttgcaaccacgtcgtttttgcttacttctttcccctcatcaaggttccagtcagttactttacccgcagcaggagctgtgatagcagccatgtcgccggcaactttcgcttcatcggtttttacatagtgtgtgctttgataatagtagtaagcacctccgcctataattgcaagaacaacaatcaaaccgataatgttggtcagaattaaacgtcctctgttcattttgttttctcctttcgtttcttcctctatcattttgtggaatgatgataaaaatatgtggggatttttttattttccgtttttcactgcacagccgtttgcaagcttcgttaaactttccgcaagcttgcgcaggtactgcagttcagcggtattgagctgccggtataagaccgccgctttttcggcatattgaacagcagctttctttagaagttcttccccctcttcggttaactgaatcataacaacacgccggtcgtcgtgatagtcgctccgaaccattaggcggcgcttatacagaatatcggtcattctcgtgacagacgccggtttcagatcaagcgacaaagccagccttgaaagctgcgtgcttttgctcttatgtattttgaacatcagcagatactgcagcactgtaatatcaaaaggttcaagcactgtctccagaatcattttctgctttttgtaaatcgatctggaagtatcaaacagttgttcaaaactgagcaaagcgagctctgattcaatcaccgtattttcacctcattcccttaataatagttcacaagataaaatattaataaatgaaagaaggtttgtaaagagaaaagtttcattttttaaggattttttttatgccgttttttctctttatttttaatttaaaaaagccgggtgaagaaccgcggccgcacgattcttcactcggctttatatttaatacgatgctttgcttataccggcttcctcatttttaaaaaagcttttcagcgcttgaaatacgtccgatttctgtttcaggatgtagtatttaaatttatcatctttgacatttttataggcggacatgagggtggaatgcctgttatattgattgacctcaccgtaacagaacagattcgattttttcatgatgtcattgacgagctttacgcaccgggcgttatccgaagtcaggttatctccgtctgaaaaatgaaacggatagatgttgtagcgggcggggtcatatttttcatcaattaattcaagagacttccggtaaacggaggaacagatggtgcctccgctctcgcctttcgagaaaaaatcttcttccgacacaaccttcgcttccgtatggtgggcgataaattcgatatcaaccgtttcatactttgtccgtaaaaatcgtgtcatccaaaaaaagaaactcctcgccatatacttttcccatacgcccatcgaaccgcttgtatccatcatggctaaaacgacagctttcgattccggcttcgtcacatcattccatgttttgtatttcagatcttccggataaatagggtaaaacgacggcttgcctgtcatggcgtttcgtttataggccgacagcatcgtccttttcttatcgatattccctgtcagcccggttttccggatatcattgaactcgatatcggtatggacgatattgtccctttccttttgctgcagattcggcagttctaattcctgaaacagcgcttcttccagatccatcaatgaaacttccgcttcataataatcctcgcctgcctgatcgcctgctccctggccttttccggcgccctgctttttatctgcgccgtctcttgcgacgacatcgccgacttcgctgtcgccgtcgccttggccgacatgtttatttttatcatagttataacggattttatattcatcaagcgaacgaatcgggattttcacaacatcttttccgttggacataataatgctttcctcagtgacaaggtccggaaggttgttttttatcgcttcctgcactttcttttggtggcgctgctggtcgtcaaagcctttgcgatggagggaccagtcttcctctgaaatcaaaaaatttccgctgtcattacgggacatgaattcccctccttaaccgttatggtcgttttacatgtgtattccggcttggtcctgtttatgaaacaagtccggcgaaaagatttatttttatcttatgccggccggactctccaattgacaaacaattgcgaaaaacagacaaaagaacccgtccttttacagacgggcctctcaatgaaatcaaatatcagcggtttaacaagcttccgacatacttcagcagttcattagcgctagtcgaattatagccgtgttcatctattaaccttgccactacctcattgacctttttaagctgctgttcatccggcgttttggtggaggtcgtaattttcactacatcttttaagtctgcgaacagctttttctgaatcgcttcgcggagtctttcgtgcgaattatagtcaaagcgttttccttttcttgcataggcggatatgcggattaagatttcttcgcggaacgcttttttggcgttttctgaaatgccgatctgctcttcaatggatctcatcagtttttcgtcaggattcatttcttcacccgtcagcggatcgcgaagcttatttttattgcagtacgcttccacattatctaaataattgtccatgagagttttcgcggattcttcatatgaataaacgaacgccttctgcacttcctttttggcgatgtcatcgtactctttcctggcggcggaaataaaattcatataccgctctttgtcctcggcggagatggacggatgctggtcgagtccttcttttaaggaacgcagcacgtcaagcgaattgatggattccatattttttctgataatcgttgaggaaatgcggttgatgacatagcgcgggtcgataccgctcattccttcatcatggaattccttcttcatatcctccagatcaacggaattgtaaccttcaacgctttctccgtcatagagcctcatttttttgacgagatcaatatcagagcggttcggttccttcagccgggtcaaaatagaaaacatcgcggccacttttaatgtatggggggcgatgtgtacgtcagaaacatcactttcagaaatcattttttcataaatccgttcttcctctgacacctttaaattataaggaacaggcatcacgatgatcctggagtgaagggcttcgtttttcttattggcaataaacgagcggtactccgtttcgttcgtatgcgcaacaaccaattcgtcggctgagatgagcgcaaaccgtccggctttgaaattcccttcctgcgtgagtgacagaaggtgccacagaaatttttcatcgcatttcagcatttcctgaaattccatcattccgcggttcgctttatttaattcaccgtcaaaccgataagcgcgcggatctgattccgaaccgtattcggcaatcgtagaaaaatcaatgctccccgtcaaatcggcgatatcctgtgatttcgggtcagacgggctgaaggttccgattccggtacgtttatcctccgagaagaatatacgttcaactttaacatcctcaattctgccgccgtattcttcttcaagccgcatgacattaagcggagaaaggctgccctcaattctgatgccgtattctctgtagaagtcgtcgcgcagatgatggggaatgagatggagaggatcttcatgcatcgggcagcctttaatggcgtaaacagcgccgttatctgtcaatgagtaggcttcaagcccttttttcagcatggtgacaagagttgactttccgccgctgacaggtcccatcaatagtaaaatccgttttcttacatcgagccgcttggcagccgggtgaaagtattcctccacgagccgttccagagattcctcaaggccgaacagctccctcgagaaaaagctgtatgtctttttcccgtcatcctcctcgattccgctgtcttttatcatattaaaaacgcgagaatgagcagactgcgcgaccaatggattttcttttatgatctccaaataatcagcgaacgtcccttcccatttgagacgctgctcttcctctctgtacttttcaattttctttaatatatccataagaacctcctctatcatggttaatgcactagaaataaggtactttgttacaatctatgcggtgacgtgataatacatgcttttcgtttcttaaaaataaagacgttataaggccgtcattgacaagggtccggtgcaccgttcataatgaaagaaatacagtttcatccagactcggacatcaaatggaaaagcaaagaggaggagacatgatgaaaacgatcattttacttggggtcattctcacttttttagtatccatttttactgcgggttacgacagcaaacctgaaaacaaataacggcaaaagggtgctctttatgaagagcaccctttcctgtacaacataacaatgtttcatatttgaatatgttcttggacagttgatttttcatgagacttacagcttgtttgatactcgatttttccgattttgcagcccgggccgatttccacacgcttccctctgacgatgtccgcttccgtggattcgaggtaaattgcgtctccttcgatcaattcagcagaaagcatgccggctttccgtttaagaaaaccgggtttccgtctgacggtaatcgatgtgccgccgatttctttcacgcggcttcggtcataacgcaaatggatgtttacgtcccctgcgtttaacaatcccgccacattgatacatcctgttacatgaagcagctccgtctcgcaatcgccgccgacggtgagactgccttttatatgacactgttctcccgcggccccgccgccaatttcagcaagtcccttcagcctcatcctggcaaaacgcatggagccgccgactttcaatgtgccgatcacatttgctgaatgtgctgataaatctcctgcaacttcatgctctccgaaaattttcagcctgctgatctcggcatctccgagaaaaagtcccgtgccgaatatccggcagcgttcgctttgaagtccttcgccgacagttccttcccctttaatgcttacattttggtaggaaccgccggaagcgtgtccggctccgtacatttttaaatgactcaatttttttgtcgtttccattgcagctcctcctatcgtttcacgactttgttaaccaaagcggtaggatcacatgtaaaatcgccgctgtattccaccgtcccaatggtgcagcccgcgccgatccgcacatgatttccgcggactgtcttcgcgttcgtgtccgccaattcaatgatgtcaccctcaatcagctctgctgtcagcaccggggccggcatcagcttaaaacgcgtaagcacgctctttctgctcatcactttcaaatggcggcagccgatttctttcacatgactttctcccgcagccagcttcatactgacttcatcggcattcagcaggccgccgatcttgcatttgccttccgaacggaatgtctctgtctcgcaatcaccttcaatcccggctttcccggatatgaaaatatcatcagctttcacaccgccgccgaaagatgaaaatcccgcgacgttcagccgctccgttttgacatcacctttaatgacacccgttccgttgatacggatggattcagcttcggcactgccggaaattttccccgaaccgctgattgtcagtgtttgcgtcttgacatgtccgtctgtttttccgctgccgttaaacaaaaggctcgtgcactccacatcacctgacaccgtgccgctcccgttgatctccactgtatgaaaacggcctccttttgaacttcccgaaccgttaatgattaatttatctgttacttccattgatggtcctcctgcatccatttcgtttttaattcttccgatgccgcagcaagcgccacccgttcaaccactttgacagtcggttcaaataaaatatgttccgcgtctgcgatgaagcacgtcgttacgccgagctttcggagcatgacaagctccgtattcgctttcagctcggaagcctcatacgtcttcagcacccccgccgccaattttccttcctcaaggctgatattgcccgattgcaaaagcccttcaagcacatataaagacagcagcgcgcgggacgtgaatgtcacgccgtcttcgccataaacttgcagcgcggcttttgaaatcagtcccttttgaagcagttccgcagacgttatattgacatcagtcatttgcggagacagcatttctctcatttcatccagagacagattttctttcatttcctgtatttttgagatgcgttttaatatttccgctctcggaaaaaatgtttcctggcctgtaaacgtcgattttcggataaaccattcttcaggaattaaatttttccgtttccaccggtacagctgcccgtatgaaattgatgtttcttccagcaattcttttttagaaatcagttgttcctccatgaatccagctccttcgatgaacgtattgtaacataacactgttacgttgttaagcccggaaatataaaaatgccgtaaaccgctgctgcccgtcttttttattcaataaaaaaacgcccggatgcgggcgttttttctcacgtcaaatctctgtaattttgctggcgcagcgcttcatatacaagaatcgcggccgtgttggacagatttaatgatctcacatgctcggtcatcggcagacgcaggcagcggtccatattgttttcgatcaattctttcggaagtccgctcgtttctctgccgaatacgaagaaaaagtcttcctccgtatttgagtaatcaaatgatgtgtgcggcttttgaccgaattttgtaatgaagaaaaactttccgttttcatatgcttcaaataactcttccaatgaatcatgatatacgacgttgacgaactcccaataatcgagtccggcgcgcttcagcattttatcatcggttgagaatccgagcgggcggatcaaatgaagcgttgtgtctgttgccgcacaagtacgtgcgatatttcccgtattggccgggatttcgggttgatataaaacgacatgtaatgccacgatgttcacctctgttttttattccgcccaccattatatcattaattactcttttgtcgtatcatccgtaatatgaaaaaacgcatatctgatggaaggagtatacgccgttgaatcctcatatgaccaatatctcatcctgctgtcatacgtttgggcattgacgagcggcatattgcttttatcttttgcgaccacgatcgccgtatgattaaaacggccgtctccttcaaaatcatagcaaatgatatctccgggcatcagttcttcagctcttgatacttgcactgcgcgaagccctgccttggattgggccagatacatcttcatcgaatgcgcgaccgtccagctgtagctccacgagcttgccttcatccaccagcctgagcctctgttcggatgcccccgcatcggtgcttttccggcatgtaaacattgggaaataaaattggtgcaattatcgctgaaatttttataagcgggatttcgtttattccaaaacttctccgcgtactgcacggcagccagacggtcgtattgaaacgcccgcccgaaatcttcccgttcactccgctcatattcaattacgctgtttccgtcagaaaatccagccggttttttctttacttcccggtctttaatcaaaagctcatcatagagaaatgcagtccgttcctcaatctgctcttctaagtaaaggtgtccgtcatgctccttgcacaaatattcgaaatgaatcgtgtacatgacacataacgtgccgtcgtcctcaagactgcttttgacaatgacggcttttgccttcgctttcacgatatcaactttccgtttttcaaacagctctttttttctcgtcaggacctcaagatcgccggcctgcccattctgcctcatctcagttccgttgattaaataatgaagccgggcctccgctaaatcttcaataatatgcttcaagcgctccacccaccatacgattttataaagaaaaaacacttgaactccggccaagtgctttttctctatacatatgtcaggaccggccggttttagtcttctcagaaaccgataacagctccagtcccttttcaatttcccgtatggcgtcttcatcctgctccttttgaagcgctttttctaattcctccgcataatcaggatcaccgattttcccgatggcccaggcggccgtacccctgatgacggggcgcggatcttggtgcatcaaggccgttaattccggaagagacgaggcatctttaaaatgagccaaagctaaaatcgcattccgctgtatcggcttcttgccgcgccatgatcccgatacatgtccgaatttttctttgaattcgcggttgcttatggtcaaaagcggctttaacagcggctttgcgatttccggatcaggctccatctgcggatgaagatgaaaatctttccccttattaatcggacagaccgtctggcacgtgtcacagccatacagacggtttccgattttcgtgcggaactcatccggcaaaaatccctttgtctgggtcaggaacgaaatacagcgctgggcgttaagctgtccgggattgacgagggcgccggtcggacacgcgtctagacattttgtgcacgtaccgcacatatcttcaatcggcacatccggttcaaagggcagattggtgatcatttcagccagatagacgtaagaaccgtattcaggcgtggtgatcatgcagtttttggcgctgaagccgattcccgcccgttcagccacggccctgtcggacaattctcctgtatccaccattgactttgtgcggatatcctcatgtttgctttggagaaaattctccagcagatcaagcttttcccgcagcacatcatgataatccttccccaggaagctctgcaaaaaatgccgcgccgcccgtccctcgtgctcctcggcgcatctttcattttggaaggataagcaagggcgatggcgacgattgatttggctttcgggagaagcaaagacggagtaacccgtttttcaatatccggctcttcaaaaccggataaatagccgagtgattcctgaagaatcagccggtcccgcagactgtcgaacgtatcagccgttgtaaacccgattttgtcaactccgatgcttttggcgtattcgattaattcctctttcagtttatgaatattcattttttgcacagcctcctttctttgtgatcaggctcccgcacgggtataatagagttttatcatcccgaaatggagtgaacacacttgaacatcagtttagatccacttattgctgaacgggtgccggggatcaaagcggcagccgtcttatatgaacagatcgaagtcgggcctgctccgcaaatgctgaaaggccgcctccgtttatttcaagaatctctttactttgattatgctgacggcggtatagatgagcagccttttgttaaagagtgggcgtgtataatggaacagctcagtcccgccttttcaggacaaaaaacgccgatggagcttatgctcggcgatatttcccgggaacgattcattgaaagtgtgaattcagcccatgataccatactttttttctccttgaaatattcattgcctatcatggcgtatgacgccgcagaaatagatgaaccgatttcgattacaatcggagaaaaagaacacgtacttgctttctccgactctggcggcattttcggcggccttaccggacatatcaacacccgccctgtaacaatcggcacaaagaaaatgctgcagctgatctttttcccgccttcatttcatgccgacgcggcggatgagctgctatcatctttaaccaaaatgtttgaacaaattcacggaggcacgcataccgtctcttggctttcataaaaagacacgccttcgtgtcttttttcacataaaaaaacgcaatacttcgtttatcagagaaacgaaacactgcgttaataacgtatgtatggagcgggtgatgagaatcgaactcacgacatcagcttggaaggctgaggttttaccactaaactacacccgcatcaaagttttttgtcagtaccgatttgatgtttctaatattacatgtatatttttttttcgtcaagggaatgttaaaaaatttgtcgaaaaaaattcttttttcgtccacatgttaagttaggtttacattttgttaagaatctcatacaatataaaaaagaagaaaacttgaggtacgccctgatgatgaaaaataaagtaaaagagctgagagccagattcggctattctcaggaaacgctcggaaaagaagccggagccaccagacagacgattgcagcgattgaaaaaggagattatgtgccttcactcttattggcgcttaacatctgccgggctttctccctgccgatggaggaagttttctggctggaggaggagaaaaaatgagtttgaaaagaaaagcgtgttttcaccttgcactctacggattggcctgctggacgcttatttcctttatggaagcggcgccgcggatcgctcagtttttccaaacggaggggagcggtgcatttgagctgaatatcactccgtttctgctgtttaccgtttgtgccgcattgtatatctatgccgaaaagaaaaaacgaaacggcaaaaagcataggctagtgcccgatgaatttgaggaacaggatgaaagagaacgaatgatgacggctaaagcttgccgttcctcgtatatcgccgtttacttctcattgccggccgcagccgttctgcttttgttttatccgctgattcagccgcatctacctttttttccgattcttttgattttcattctgatgatgattcagcatttggcttatgttttcacttttcataagcacggcaaaaactccggttcatgacagatccggagttttttatgttaccagctcgcttttttcaccccgggaacccggcctttatgggccagctccctgaatgcgattctggacagtttaaattttctcatatatccgcggggccgccccgtcaccgtacagcggttatgaagcctggccggagcagaatcacgcggcagtttgctcagcgcttcccagtcgccttttgcctttaattctcttcggatgtccgcatattgttcaacaagcttctgccgcttgagctctttgattacttttgatttttttgccatttcagcactcctaacaaatcgtaataattacgttttgtatcatatcatccagatgagcatcgtgcaagctaagcgcttaaaaaggcgggtgaatacccgccttcactgccggcatttccccggaaatgaatccgcagaaagcgcccgccgtcaatgatccgccttgcgacgtcatcagactgtcgctttatttcctcttgcaaaatggtcgtttcccattgcttcacccactctgcgctcaagcttgttagtccgttcattctgaaacggcagaagcggaaacacgagttcagccagataataagcttcttccagatgcggatagcctgaaaagataaacgactcaatgccgagtgcctgatactctaaaattcgatcagcgacagtctgcggatcaccgacaagcgccgtgcccgctccgcctctgaccagtccgatgccggcccagagattcgggctgatctcaagcttcgagcggtcaccgttatgaagatcggccatccgtttttgtcccgatgaatcagcgcgccggagcgcagcctgcgctttcgcaattgtctcttcgtctaagtggctgattaatcgttcagccgcttcccatgcctcttcctcagtctcccggacaatcacgtgaagtctgatgccaaaacgcatcgtccttccttccttggcagcctgttttttaacggtttcaatcttttcttttacctgctccggcggctctccccatgttaaatagacatctgtatgtttcgcagcagcctcaattcccgcctgtgatgaaccgccgaaatataatggcggatgcggagactgttttggcgggaacaggaggttgctgttttccaccttgatatggtccccttcatatgtcaccgtttcgccccgcatgagtccgcgccagacggttaaaaattcttcagtcgccttataacgttcatcgtggctgataaacatgccgtctcccgccagttcataaggatctccgcccgctacgacatttacgagcaaacggccgtctgacagccggtccattgtcgacgccattctcgcggcgacagacggctgcatcagtcccggccggaccgccactaaaaatttcaagtcactcgtttcccccgctaaagcggcagccgtcagccacgggtcttcgcatgatctccccgtcggcagcagaacccccgtatacccgagtctgtccgccgcctgtgccacttgcttaaaataaagatgatccgccgttctccctcccgtttgcgtccctaaataccggccgtcaccatgcgtcggaataaaccaaagaatctccatatgaatctctccttttttaataggttacccttcataactgttccgccattttaatagtttccgttcgagcattctgaccaatgcatctgtcagcttgccgacagccgcaaaaatgataatgccgacaaacaccttatttgtctgtgaaaattgtctggcatccataatcatataaccgacgccctcgctcgatcccatcagttccgccaccacgagaccgagccacgcaatgcctagggagagcctgatgccgagcaggatattcgggagagatgccggaagaattaatttcgtcatctgctgataccaattaaattccagcacccgcgcgacgtcaaacagcttcgcgtccacactgcggattccgagaaacgtattaatgtatacgggaaaaaaagcccccaatgcgatcagcagaattttagatgtctcatcaaatccgaaccacaaaatgaacagaggagtcacggccaagtgcggaaccgtcctgagcatttgcagagacggatcaaggtatgcttccgtccgctttgaaaaaccgaccagcagcccggaaacaagtccgaggcccgcgccaagcagaaatccggcagccgcccggtataaactgatctctaaatgaccccaaagctcacctgaaagaagaagttcctgaaacgtctgcaagatgacgacaggcgacgagagcaccgcggccgagacgatgcccagacttgcgataaactgccatactgcgatgaccgcagccgggagtacaatccctttcatccattggtatgaatacttccgggatcttgccagagctttcttttctgattggcttattgcgccggcagccgttgatgcttctgctttcattacttgccatcccccgtttcaagcgcttttttaataaatgaattgtcgacaacgtcttttacatgaattttcttatgaatcgcttttgttcgatattgaaaatcagcggtttcctgctgggctttgacaatatcatcatcgatcggttcattgagaggctcagtattgttaagcacgtttctgacgactttcggatcaagatgtttgattttcgcatataaggagacggcttcatctttgtgttccttttgccatgtaactgctttattgaacactttcagaaaacggacaacctcatccgggtgttctttggaaaatcccgttctgactaatgtgaaaccgggagaatataaatctgtgctttctccgttcgccaatatttccgccccgtgctgcagcgtttcaatcgacaaatacggctcccaaatggaccatgcgtcaactgatttgttttcaaaagcggaaaccgcctcatcgggctgaagctggatgatggtgacgtcatcggcggaaagccccgctttatctaaagctttatagagaaaatcaaagccgctgctgcctttggctacggcgatttttttacctttcaattctttcaggctctgaatcccgctgcccttgtttacgagaatgccgtttgcctttaacccgtcctgagacagcccgatctctttaaaatcaattcccgccgcctgaccggaaatgaccggtgaattgccgacctgggaaaaatcaagcttatcggcggcaagaccttcaaattgcggaggaccgctttggaattcgacccattttacttttattccgtcttttttgaaggcctcttcaaaccagcctttttccttggcaatgagaagcgggcttaaactctgctggatgccgatccggatttctttcaccgttttcccgccccctcctgtcccgtctgcactgcatccggctgacatcatgactgctgcggctaaaagaatgatgatttttttcacttcgcttcgtcccttctatattccggacccatccgcaaaccggaggtcttccgttttctcaaattcagaaagcaccttctgccggacggcctgaaaatccgctgacgtccgattgcgcggatgcggaagctgaatcggcatcaggctgtgcagccggccgggctttgccctgaggatcgccagcttatcgcctaaatagacggattcatcaatatcatgcgtgacaagaatcatcgtcgtttttttctcgcgccatatatcaagcagcacatcctgcaaatgttttctcgtaaaagcgtcaagcgccccgaacggttcatctaaaagcagcacctccggctcacgcaaaagggctctggcgatggcaacccgctgcgacatgccgccggataattcgcgcggataagcgttctccgctccctgcagcctgacaacctcaatcagatcatccacttttttccgaacggccgggtcgttcatattgagatcggcagcgatgttttgttttaccgtcagccagggaaacagccggtgctcctgaaagataaatccctgccggatgcccggtcccgacacattgcggccgtttattgcgacagagcctttataatcggtatcaagaccggcaatcaattttaaaagcgtgcttttgccgcatccgctcggtccgatgacagtcaaaaattctcccgatgcaattgacagctcaatatcattcagcaccggcgttttccggccttcatgctcaaaagctttttcttgtatgctgatggttacagccatctgtcttcccctctctttctgccgcatgcgatcgaaaaacaaaaaggcccccatctccgattgcttgcagagatgggagccttcggcggtccgatcggcaacccgtttgtttttaaatttgaatatcatgttaattcaaattattccgacttgtcaactgttttttgtatgaattaaaaatgcgccttccggcataaacctgccaaagagcgcatcggctgtatcacgtatttacttccttttctttccgggcgattttcaataatgtctgcgcgttgttgccgaaaatgttttctatatcttcttcccgcatattgatttcccggcaggtcctcacctgctcctgaagatatctgtatacatatcctctcggaaatccgttcgaatccgtcccgaagatgatccgttcagcaccgattaattcagatgtctttcgaaacagaatttccaaatcaagccggtacggcatccacctcatccactgatttgagccggacgtgtcaatatacacattcgggcagctccagcacagctgcagcagttcctgataatatccggcgccgaaatgcggaatgatgaacggtatatcagcatactctctcgcgacgcgatagatggagagcgggttgatgttgcgatggctgacaatgcccccgctctccctaaaagtccgaagtgaattaatacaggcagtcttttgtcagccagatacgtccacagctttttcagcgacggatcatgaaactcgatgtctgtcagcggcccgaacagtttatatcctttcagaccgagctcttcaaccgctcttttcagctcctcatacgcatccttttgttccaaaggatgatatgcaaatccggtaaacctcgcgggattggcttgaataaacgccgccatccggtcattgctctctgctgttaaaaaattcagcacgtcaatgccgtacttatctaattctttctcccatcttgtcatcaaagcgatttcgccgtcatcgccatcaacatcatgcggatcaggaaaatcccaagtgagattcattctttccgaccgctcccggttataatcggaaaatgtcttatcgtttttgccgaaattaaggctgtacggcagatgaccgtgaatatcgacaggtttaaaatgctgccggaaaagcatacaatcgccgcctcccttaccgcctgacaataaaaaaaggcccttatccagtgaagaataagagcctcttgtgtccaagtcagcggtttctattttttctcatattaaacccattattcccgtcagtcaagtgtgttattaaacccataccttcttttcgataataaaaataattattttataatcattataaaataatattgactttttactgataggtgatattatgttcttataaatttaaagaggtgatcacatgagttcaaataaactgacaaccagctggggcgctcctgtcggagataaccaaaactcaatgacggccggcgatcgcggtcctgctttaatacaagacgtccatctgcttgagaaattggcgcactttaacagagaacgcgttccggagcgtgtcgttcacgcaaaaggcgcgggcgcacacggttattttgaagtcacaaatgacgttacaaaatatacgaaagccgcatttctgtcagaagtcggtaaacgcacgccgcttttcatccgtttctcaaccgttgcgggcgaactgggctctagtgacacagtgcgcgacccgcgcggatttgccgttaaattttatacagaagaaggaaactacgatatcgtcggaaacaatacacccgtgttcttcatccgcgatgccatcaagttccctgactttatccatacacaaaaaagagatccgagaacacatctgaaaaatccgacggccgtttgggatttctggtctttgtcacccgaatccctgcaccaggtaaccattctgatgtcagaccggggcattccggcgactcttcgccatatgcacggattcggaagccatacatttaaatggacaaatgataaaggcgaaggcgtctggattaaatatcactttaaaacagagcaaggcgtgaaaaaccttgatgttaatacagccgcaaaaatcgcgggcgaaaatcccgattaccatacggaagatttgttcaatgcgattgaaaacggcgatttccccgcatggaaattatatgttcaaatcatgccgttagaagatgcaaacacatatcgctttgatccgtttgacgtcacaaaagtatggtctcaaaaagactatccgctgatcgaagtcggccgcatggttctgaaccgcaatccggaaaattactttgcggaagtagaacaggcgacgttctctcccggcacattagtgcccggcgtcgacgtctcacctgacaaaatgcttcaaggccggttgttcgcataccatgacgcgcatcgctaccgtgtcggcgcgaaccatcaggcgctgccgatcaaccgttcccgcaatgaagtgaaaaactatcagcgtgacggacaaatgcgttttgatgataacggcggccgctccgtctattacgagcctaacagcttcggcggcccgaaagagtcacctgaagataaacaggcggcataccctgtatcaggtttcgctgacagtgtaagctataatcatcatgatcattacacacaagccggcgacctgtaccgcctgatgagcgaggaagagcgcgcgcgccttgtcgccaatatcgtcagtgcgatgaaacctgtggaaaaagaagaaattaagctgcgccagatcggccacttctacaaggctgatcctgaatacggcagacgcgttgccgaaggactcggactgccgtcaccaaaataacatcaaaaaacctgccggtctgcccggcaggttttttatgttcattatcaataaaaccgtttttttctcaattacacgaagtggcatgccgcaaaatgatgaaaccctttttctgacagcgccggacttttctcagcacatatcttcttggctgccggacatctcgttcggaatttacagcctgaaggcggatcagaggggcttggtatatcaccctttaaaattatccgctcccttttcgctccgggatcaggaacaggcacggctgataacagcgctttcgtataagggtgaagcggccgtgaaaagagctcctcctttgacgcatattccacaatcgtccctaaatacataatggcgaccttcgtacataagtgctccaccacgcttaaatcatgagaaatgaacaagtatgacagcccgtgctgtttttgaaggctgctgaacaaattgatcatctgcgcctggatggagacatctaacgccgccacgggttcatccataatgataaattgcggtttgagcgccatcgctcttgcaatcacgatccgctgccgctgccctcctgaaaattcatgcggataacgatcgatgaagtttgcggaaagtccgcaggcttcaagaacctccgccgctttatcacgcgcattccgcttcaccgccaattgatgctcgatcatcgcttcaccgatggcttctccgatccggcgccggggatttaaagaactgaacggatcttgaaagatgagctgcgcttccgatctgaaagttttgagctcgcgccggctcatccgaaacacatcacgcccctgaaaaaacacctctccccctgttttctcatgaagcctcaaaatggtcttgccgattgatgactttccgctgcccgattctcccgctaagccgaacacttctccctttcctatcgtaaaactgacaccgtcaaccgcttttacgggttttttatgagtctttctcatccccccatgctcctcgtaatattttttcagccccttgacctccagcaacacatcactcatctgctttctcctctctgtaaagccagcacgccgcctgatgccccttcccgaattcagtaaaatgcgggctcgatctccggcatatttccgtgctgtgttcacatcgctccgcaaaataacaagacgatcccgacaggtccgcaagctcggggacctgccccggaatggtgtaaagcgtctcccttttttgaccgataaccggcttggccgcgagcagccctttcgtatacggatgcttcggatcagaaaacagctctgcaaccggtccttcctccacaatttttcccgcatacatgacaatcacataatcagccatttcagcaaccacgccaaggtcatgagtaatgaataaaatagacgtgcgaaattgctttttcatatcccgcaataaatccaatatttgcgcctgaatggttacgtcaagcgctgtcgtcggctcgtcggcaatgatcagtttcggatcgcagcttagcgcgacagccgtcatgatgcgttgcagcatgccgccgctcagctcatgaggatatcggtgcataacctgctcggcattcgggatctccactaacgtgatcagttcaacggctctccgccatgcctctttcttactcagcaacaaatgttcgcgaatcggttcggtcagctgctcaccgattgtaaacaccggattcaaagatgtcatcggttcctgaaaaatcatcccgatttcgcttccgcggattttctgcatgtcttttggtttcagttccaacaggttctgtccggaaaaatgcaccgctccccgttcgattctccccgtctcgggaataagctgcataatggacaatgacgccatacttttcccgcagccggactctcctacaatacaaaccgtttcctcctcatgtatcgtaaagctgactccgtccacggcctttaccgcaccctcctctgtataaaaagccgtttccaaatgccttacttctaaaagcggttttttcatttcattttcacctgccgttttaccttaggatcaaaagcgtctcttaaaccgtctccaagcaaatgaatcgccacaacggtcagaaaaatggccgttcccggcggaatccacagccacgggcggagtgtaaaatccataaaatgattcgccgcttccatcatgtttccccaagaaggtgtcggcggagcaacgccaagcccgagaaaactcagcgcagattcactcagcatcgctcccgccacatgcaaagtcgccgctaccagtaataacggcaatgtgttgggaagcaaatgatagaggattttccgtttatcactaagccccaaaacttccgcggccatcataaacagctgctccttcagcgacaaaatctgtccgcgtacaagccgcgccaaaccgggccatccgatcaggcttaacatcatcataatcaggtacattctgtattcagaaggcactttccactccgacatcaccgcagccaaaatcaaaagcagcggcaggcccgggatggacatgagcatatcagcaatgcgcataatgatcatatcagcggctccccgataaaacccggccgcagccccgagtaaagagccgatgacaagcgacagcaccattgaagcaagccccacggtcagagaaatctgccccgccagcatcagcctcgtcagcacatctctcccgtactggtcggtgcccagccagtgatggattcccggatgctgattggcatttgaaatatccgtccgatctgttatgtacggagaaaaagacggcccgataaagcacaataaaaacataaaatataagaaaagaagactgatgaccgtcagcttatgctgcagcaggcggcggtacgtctgcttccaaagagaaggcggcacctctttttgttttttcattccgaacaccccctatttcagtctgacccgcggatcaaccgcggcataagcgatatccgccaagaagttccctacaatcgttaaacaagacaaaaacaaggtaaacgccatcaaaaccggataatcacgataatgcacagattcaagctgaatacgtccgacacccggccacccgaaaatctgttcaataatgatggctccggaaaacagtcccggcagttcaaaagcaagcagggtgatggccggaataagcgcgtttttcaacgcatgtttccagatgacggtgcgctctttcaatcccttcgctctcgccgttctgatataatcctgtctgatcacgtccagcatgccggagcggaaataccttgtcagcgagccgatgccgagcatagataaaatcacgaccggaagaatcatatgtctggcggcttcaagcacgtacgaaaaacctgtactcgtgctgccggtatcaatcatcccgccgacgggcaatattttcaaatccaccccaaaccacttaataaacagaaggctgataaaaaaagacggaaacgccatggaagcaaaaacaagaaacgtcacgatcccgtcaaaccatgagtatttcctgacagcggatatgacacccgttatcatcgcggctgaccatgtaacaagcaacgccaaaaacgcgacaaaaaacgaattccagacatatttccgaagcagtgacaggacgttctcctgatatttcaaagaaaacccaaaatctccgctgagcacatttccgagccatgtcacataacgctgccaaatcggctgatccagcccgtaaagcgcttttaactccttcgctctttccggagtcaggtttacattggaatcaatatagtcgcccggcagcatggcgaataagaaaaaaataataaaggacgtaccgaataagatcacaagcatttgaatgaatcgttctgcggcataccgtttcataaaaagcccctcctttccgctgaaagggcaaaatccccaggatgcatcgggtattttgcccaaccgttctattgaattgagacatttgagagacttgaactgattccagaataattgtcagcctcaagcccttttatttttccgctgaccgcccttgcgctctgacggtaatgaatcagaatgtaaggcgggttttccccgagctcccggtacagctggtgataaatctcttttcttttgctgatatcaagcgtgccggctcctttctctatcagccggtccgctttcggattggaataccccgtcacattattgggatggccggaagccagcttttccaccgtgtcattcggatcaaggatctgcgaggtggaaacggcggcaaggtcatattgtttgtcattgattttcgctacttctgtattaaaatccatcacttccggttttaatgagattccgatgtccgcataattttctttcgctatcgggatgaaatcatcatccgctttagatgtgtaatagctgatttcaagctttttgccgtttttttcacgtacaccgtctttgcccgttttccagcctgcttcgtcaagaagctttttggctttttcagggttaaacgcataccgattgacacctttgtcatcataagcccacgaaaccggagacaccggaacattcgcgacctctccgtagcgtttaaagcggacatcgacgattttttgacggtcaagtccgtaaataagcgcctgggacactttcttatcttgaaaaggcggacgcttgtgattgacgtacacaagcccgtaatcattcacgacagatacgcttatattcgcaaaaccgagactttttaaatgctgaaccgtatcatcatcaggtgagaaagaagcgtaatcaaggtcacccgtttcaaacagctgaagggaagttgacggatcgataattttataaatcagcttttccgttttcggttttccggcataatagtgttcattagcctgatagcgtatttcctgtcccggaaggtattctgtaaattgataaggtcccgctccgagcggtttggcataaagctcttttaaatagtccagtttgccgaattgatatttcttcccgtagtaggcttctgacagcacctgcccgcccaaaagaagcagcgacttcgcactgactttctcagtcgtgatttgaatggttctgtcatcaaggacgcgaatgccctctatcgtctttgcctttccttctttgtaagccttaccgcctttaatataagccgtggtgatatcttcatagcccgcgtatgcaggatcatgcagcagtgttaaagtgaatgcggcatcctttgcggtcagcggtgaaccgtcgctgaaaacgagattttttcttaaacggaacgtgtatgtaagctgatctttggaaattttccagctttccgcaagagccggggcaggcttccccgttttatccagtttgactaacggttcaaaaataggatctgtcgcatttccatcccagccgttttcgtaaaagtacggcagaaacacgccgcccggcgcggaaatcccagcaacaaaagtgtcagttctggctttcgatttagcgggaatcgccgccggatgagaagctttaaattcctttgtcttgacatgggtgatacgtgtttcttcctttttatcagccgcagatgacggttcttccccggcactccctaacgcgcaccctgataacatgatggataccgacagcgcgagtaccgttgttttcaacctccattttctctccttcatctttatcgaacccccgcatgcttttcatctatctttatataaatctgctccatctgttcctcatttctcataatctcccgtttgtttttctctacaagcagttcgaaattcaatgtgtgttttctgtactttttccgcttttttctctttttgcgcacatgtgataccttttttaacgccacttttcatccctccgcttttcatttaatgactttcacgcaaaaaaggcccttatctgtttaatagataagagccttcggtgatccgatcagccatcgtttggaaatatgtaatgattatgttaattcatacaatccctacctgtcaactacaatttaaaatatcgtgtccttccgggggttttcctcatacactctctcatttttccgcatatgctagaaaacatagcagattacaagtgaaagtgagtgagaatgtggaaaagacaacattgagcggtcgcatcgtcaaaaaagatgacccggactataatgccgcaagaaccaatttcaatttaagcctgcaaagatatccagacatcattgtgttttgccaaaacaaacatgacgccctcaatgcggtgagatgggcacgtgagaacaatgtgcctttccgtatcagaggcggaagacacagctacgaaaatttttccctgttaaatgacggactagtcattgatctcagtgaaatgaagaaaataagagtaaatgaggataagcggctggtctcgattgaagcgggagccgaattaggggaagtctaccggacactctggcggtacggcttgacccttcctgcgggaaccattgcgaatgtgggaatcacggggctgacgctcggggaggaatcggatatttaacaaggactgccggacttacttgcgatcgtctcctccagctcgaaatgatcatagcggacgaaaaagcgggtgctgacttgatcacagtcaaccgctcaaagcactctgatctattttgggcatctcagggcggagggggaggcaacttcggcattgtcacatccatgatgtttaaagccgtgccgatctcgtgcgtgtctgttttttctgtcacttggggctgggatgatttcgaggaagtatttaatacgtggcagcgctgggctccatttacagacaaccggcttacctcatcaattcagttttggcctaaggaagtcaaccgcatagaagcactcggtcaatttaccgggacaaaagaggagctgaaagaactgctggctccgttaatgaaagcgggaaaaccgacaagcggcatggtcaagacagtgccatttattaaagcagcagccttttttaacagcccgggaggcaatcagccgcaaaagatgaagcggtcaggatcctttattgaaaaaccattatcaacacgcgcaatatccactttaaagcgctatttagagcacgctccgaacgaaaacgccagtgtctggcagcaatctctcggcggggcggccggacggatcgctccggaccaaacggcattctactatcgcaacgcaatcattgcccaagaatatattacaacttggacatctgctgaagaagaaagacaaaatgtccgctggatcgaaggactgagaacgtccctatcaagagaaacgatgggagattatgtgaattggcctgatagagaaatcagaaactggctgcaaacgtattacggagaaaatgttcaccgcctccgtcaagtcaaaacgaaatatgatccggaaaatatattccgcttcgagcagagcattccgccgcttcgccgttcaccgtttttctaaaaaagatgaagatggatacactccatcttcatcttttcttttattgatataagcggcttcccttctctgcaaactcttttgctttttctttcagcccttcattgacggcctcgtcttcagtaagtccgttttccttcgcataatcacgaatatcctgagaaattctcatgctgcagaacttcgggccgcacatcgaacagaagtgagccgtttttgcgccttcagccggcagcgtttcatcatgatattccattgctctttcaggatcaagcgacaaatgaaattgatcacgccaccggaattcaaaccgcgccttagacagagcatcgtcacggatctgtgcacccggatgccctttagcaaggtctgcggcatgtgccgcgattttgtacgtaatgacgccttctcttacatcatcacgattcggcagccccaaatgctccttcggcgtgacatagcaaagcatcgccgtcccgtaccagccgatcatcgccgcgccgattgctgaagtaatgtggtcatagcccggagcgatatccgtcgttaatgggccgagcgtgtaaaaaggcgcctctttacaaatttccagctgcttgtccatgttttccttaattttatgcatcggcacatgacccggtccttcgatcatcacttgcacatcgtgcttccacgcaatctccgtcaattctccgagagtctccaattccgcaaactgcgcttcatcattggcatccgcaatcgaacccggacgaagcccgtcaccaagtgaaaaagcgatatcatagctcttcatgatttcacaaatttcttcaaaatgcgtgtacagaaagctttcctgatgatgagccaggcaccattgcgccataatcgccccgccgcgggatacgattcccgtcgtgcgtttagccgttaacgggacataacgaagcagtacgccggcatgaatggtgaaataatccacgccctgctccgcctgctcaatcaatgtgtcacgataaatgtcccacgttaaatcctcggcaatgccattaactttttcaagcgcctgataaatcggcaccgtccccacaggcacggggcagttgcggataatccattcacgcgtcgtatgaatgtcttttcccgtggataaatccatcatcgtatcagcgccccagcgaatcgcccacgtcattttttcgacttcttcttcgatagaagatgtaacagccgagttgccgatattggcattaattttcacatgaaaattccggccgataatcatcggctcgctttccgggtggttgacgttagaaggaataatcgcccggccgctggctacctcgtctctgacaaattcgggagacacatgctcgcgaattgcgataaactccatttccggcgtaatgatgccttttctcgcataatgcaattgtgttacatttttccccggcttggcccgaagcggtttccgctgcaggccggggtattcggcagcatgatcttcttttttatagccgttgtcttcaggtctcacggtccggccgttatattcttctacttctccgcgcccggtaatccactttgtgcggagcgcccccagaccttcatgaatatcaatctgtacatccgggtctgtatacggtccgctcgtatcataaacacggaccggcgcattctcctcttccccgaatgcccccgtagtcgcactcaggctgatttcccgcatcggcactcgtatgtcgggcgaagaaccttctgcataaacctttttactgccggaaaaactcgacataatggaaatgttcgcttgctgtactgattgattttgcatacaaatctctcctttatcatttgaataacagaaccaagctcagcaccagcacaaaaaaaccgggttcaaagaagaacccggttttgcagtcagaaagaaactattattgttttcctcaacaataataaaacctttacttccccacgctggtacgaaccagatcaggtccaaagggttaagaagccgccgcttctctctcagcccgctcagacgggcacccccagtaactattgatttcgctctcatcgtaacataagttgtgtacaaaaaaaagcatattatcaaaattcagataacggaatggtcataagctctgtttcccgaacgccttcttcggtattaaaaacccgataaccctttgcggtttcccgggaagagacagcccggaacagctgaccgtctttataatgaagcgcagcgccgtcatcagcggcatagccctccctgagtatcttttcggaaatcagacggtgatacaccggccggcgctccgcttctccgtcatagtgcggacaaaagctgcccggcaaaaatcctaaagctgttaactctcgcaaatcccccgctgaatccgtcaccccttcttcataccagcaaatcgctccggcgctgagacccgctaagatgatgccgttttcccaagcctcacgaagaataaggtcaagcccccactctttccataagacaagcatattgcgcgtatttccgccgccgacatatataatatctttcttcatgagaaaggatctgagatcagaacccggcggtttaaacagcgacaagtgatccggctcacaccgcagcttttgaaaggcctgataaaacctgccggtatatttctccgaatctccgcttgccgtcggcaaaaaacaaactttcggctttgaccgcgccgactgctctaaaatatactgatccagcacaagatgatccggctccatggaaaaccccccgccgcccattgcaataatctgcttcaatgtcatcacttctttttttctcaagtataacagctcattaaaaaggcgttatctcaatttcggataacgccttcaaaaagtatttgttatctgaaaaatacgcaccgtataacacaacggagatccccgcggcgttaatcgccggaacaagcttcgaacgggcatacttcgcaacattgatccccaacaccgtattatcactgaggggagaagcaaaccaaatgttccgctcgctaataataagctggtatgtaactgaaccgccagcgttacgccgagcgccccaagtccccaggatgacccgataaaatgggatataacagcccccagtataaaaagagacggcgcaataaacatatgagggctccatgatgttaaatgagaagtaacatatttcgagaatcccagattttcagctactgctgttacggcccaaatcagcgataacataataataacgttgaccaattcgtttccgcccttaataaaatgggtaacaagctcgcctgcaggaaagcgctgaaacataaaaagagcaaatactgcaataaccgctgccaataatgcgcgcttttgaatggccgccccaccagctgagaaacagtgttaatagcaaaaacagcccgatcggaaagatttaactccacggccgaatcggtgtttccttaatataagcacggtgcgccgaatccagctcctcctactgcaggtatcatgttttcacaagccttggagatattttcatacaacaaaaaaggcttctacaatatgtagaagcctttgtataccggtggccggggtcgaaccggcactccagaaggaacacgattttgagtcgtgcgcgtctgccaattccgccacaccggcatataatgcgtcgtgttcaaccgacgtatataaatataacatgcattctataaagagtcaatggttttagtaaagttttttcaaatggtaatgcagtatatacgatacaagcaagaaacttatattgatagtcttcacgcttttattatataaaaaaagcgacctgcaatatgcaaatcactctcatatatgttttataataagaaaattgatgaccaatttaacataattcgctcaaagttaaattggtgccgagggccggacttgaaccggcacggtagtcacctaccgcaggattttaagtcctgtgtgtctgccaattccaccaccccggcaatagaaaggcgacacccggattcgaaccggggataaaggttttgcagacctctgccttaccacttggctatgccgccgtaatttggagcggaagacgggattcgaacccgcgacccccaccttggcaaggtgatgttctaccactgaactacttccgcaacatgtaaaagaacttaatacatcttatgctgttgttttcaaaaaaatgcaactgggctagctggattcgaaccaacgcatgacggagtcaaagtccgttgccttaccgcttggctatagcccaatgataatatggggcgattgatgggaatcgaacccacgagtgccagagccacaatctggtgcgttaaccacttcgccacaaccgccataatctgaagatgaataaataatatagtggcaggggcagtaggaatcgaacccacaccggaggttttggagacctctgttctaccgttaaactatgcccctatttataaaatggtggaggggggcagattcgaactgccgaaccctgagggagcggatttacagtccgccgcgtttagccacttcgctacccctccatcatttagagtgccggccagaggacttgaacccccaacctactgattacaagtcagttgctctaccaattgagctagaccggcaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccatttttttggttgcgggggcaggatttgaacctgcgaccttcgggttatgagcccgacgagctaccgaactgctccaccccgcgatgataatggtggaggatgacgggctcgaaccgccgaccctctgcttgtaaggcagatgctctcccagctgagctaatcctccatcatataagtgacccgtacgggattcgaacccgtgttaccgccgtgaaagggcggtgtcttaaccgcttgaccaacgggccctggtattttttcgtttgttatgtattgataattagtggcggagagcaagggattcgaacccttgagacggggttaccgcctacacgatttccaatcgtgctccttcggccactcggacagctctccataattggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacgttttagtgacatgtattattatactatgtatttcggaaaaagcaagagtttttttaaaaaattctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtcccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcatctcaacctcatctcgaggcgactttttcagtataacatttcagcgatttgctgtcaaatgtttttttgtttttatttctccgccgctgtgagctttttggtgaagcgcatcagcgacgtttaataatataccatgcctatgattcagcgtcaacactttttttgaaagaatatcctcgatgatatacttcctgccctttggtctctatttgagatacttcaacaaagcctttttccgtcaggtaatcaagcatgacaccgagatcttgggtgaagtgcaccagttcagggtgctgaagcaattctccaaactgccacatttctttttctttcatcacctgaaaaaggtgcgcagaaccgatttcagcttttgaatggatgagaaaatcatttgctaagaataataattcgagccttttctccaagctttcgtgactctcgacaagttcggaatatagcttatatacctgcggctcaatgtgacggacctggttccagactgtcgtttcgggataaaacccccggtcaatcacttctatgcgggccaagtggtgaagagcgtgcactaccgcataatatgcatccagaaaatgatcagcttcaaaaaacgcttttccttctacaaatcttctgatcagcttgccgtattccattccgatctttaatttccgctcggcgaaaggaaaagtgctgagccggtcattgagttcagatatatattcattgcggtcaaacagcactttgccgttgatgatccaatctatgactcttctatttgtcccaagcagaatccattcctgaagcagagcatccgttacaatatgtaaagaagcggttttgtgttcgaattcataatgctttataaaaagaggttcatcagcctgtttcacaatgacaagcatgaccgcatcaaagttatccgtgatggatgatgctttactccttctctcaatcataaggacggccagcgtatcgggatgacttgctctttcttggtaaattggacggagaagattgtccattacgattcctccaatgcgattgtttcactagctattgtttctacatttctatgataaaacatgaaagtccttttttctaaacacattgcactattataacaaatttcctttcaggtgccatatttattcttcccttttcttacgaaaacatgaagaatatgccatatgttttgtgctatagttaaacgagagggggatggacatggcgaaatactcaagcaaaattaataagatcagaacgtttgcgttaagtttggttttcgttgggtttatcattatgtacatcgggctgttctttaagcagtctgttttgcttgccagcttgtttatgattctcggcctgctgtcgatcggactcagcaccgccgtttatttttggatcggcatgctgtccacaaaagcggtccgggtgatgtgccccgcttgcgagaaagaaacgaagattctgggcagagtggatatgtgcatgcattgcagagagccgcttacattggataaaggattggaaggcaaagcgttcgatgagtcttataacagaaaaaacagtgtaaaataaacgaagctgaccgtatcaaagcggtcagcttcgtttagtggttttcttttttggaacattcttggcagacgccgtaaatctccaaacggtggtggcttaccttaaaccctgtgacgtgagcagcaagctgttccacttcgtcaagcccgggataatggaagtccacgatttttccgcagctttcacaaatggcgtgataatggtcagaggtgacaaagtcaaatctgctggacgcatctccgtacgtcagttcctttacaagccccgcttcccggaatacacgcaaattgttatacactgtcgcaacactcatattagggaatttcccttccaaggctttatatatatcgtccgctgtcggatgtgccatagaatccacgagatattccagaatggcatgacgttgaggagtaatccggactcccgtatccttcaacgtgtctaaggcttcttttaattcatgtgcagccatccgtcatgcacctctcttctaaaaaagattcttactttataatgtttataattagtgtacatctttttccggtctcctgtcaaatgtaatctgaagaaaaccccgtgagttcagcatttgtccattaattagacgcaatttgttccaattcacgaagcgcctcggcaacgtgatctttcacttttacctttctccactccttcacaagacggccttctttgtctaacaaaaaagtggatcgctcgatacccatatattctttcccaaaattcttcttcagcttccacacatcaaaagcttccgccagtttgtgctcatcatcaacgaggagctggaaaggaagatcgtgtttttgcttaaatttttcatgtttatcacggctgtcagggcttactccgatgataaccgcatcaagtcccgcgaaactttcgtgctgatcacggaaatcacatgcttccgtcgtgcatccgggtgtcatgtctttcggataaaaatagagaacgacgtacttccctttaaaatccgtcaatgctacttcttccccgctgtcattcactaatttcatatccggtgctgtttgtccgatttcaatcgtcatttcttatacctccgggttttttattaagcgtatccaattcacgttaagattacaaccgttatcccccggctcttttctggaagcatgaacccgttgtgctcgcaatgaagcatgctacaatagaacatgatgtaaggagatattaggagggtcattttttgtatacaaaatcagttgaacttcataaggaagcgttagagcatatcgtcggaggcgtgaacagcccgtccagatcctataaagcggtaggcggcggttcacccgttgcgatggaaaaagcgaacggcgcttatttctgggatgtagacgggaatcagtatatcgattatttagcggcttacggtccgattattaccggacatgcccatccgcatattactgaagcgattaaaacagcggcggaaaacggcgtgctgtacgggacgccgaccaaacatgaggtcactttcgccaaaatgctgaaggaggccattccttcacttgataaagtacgattcgtaaactcaggcactgaagcggtgatgacaacgatccgggttgcacgcgcttatacaggccgcacaaaaatcattaaattcgccggctgctatcacggccattctgatctcgtacttgtcgctgcgggttccggcccgtctacgctcggcacccctgattccgccggcgtgccgaaaagcatcgccaatgaggtcattaccgttcctttcaatgatattgaaagctacaaagccgcgctggataaatggggttcagaaattgcagcggttctcgtcgagccgatcgtcggcaacttcggcatcgttgaacctgaagaaggatttttagaacaggtaaatgaattgacccataaagcgggcgcgctcgtcatttatgatgaagtgatcacggcgttccgttttatgtacggaggcgcgcaggatcttcttcaagtgaagcctgatttaacggcgctcggtaaaattatcgggggcggcttgccgatcggcgcttacggaggcaaaaaagagatcatggagcaggttgctccgctcggcccggcatatcaagccggcacgatggccggaaacccggcatctatcctatcaggcatcgcctgcctggaagtgctgaaggaagaaggcgtttacgagcggcttgatgagctcggcgccagacttgagcaaggcattctcgcccatgcggagacacatggcattaccatcaccgtcaaccgtttaaaaggcgcgctcacggtttacttcactgatgaaaaaatcgtcaattacgagcaggcggaaaatacggacggagaagcattcgccaagttcttcaagctgatgcttgaacgcggcatcaatctcgctccgtcgaagtatgaagcttggtttatcacaaccgcacatactgaagaggatatcgacgccactttacaagccgttgaagatgcgttcagacatatgaaaaaataacttctgaaacaagcgggagcccggggcttccgctttttctttttgtccgatttgtgagataatggttttttcaaaaaaagaccttgaataattggtatgatccctgtatattactttattgtttagcaaatcagccgacagggaaatgtaagtgtcagccgttcgttcggcacataatttattagagaaaggaatgcacgcacaaaccaatgaaacttggtgcccgcatttttaaaacagggattgcgattacgctcgcgctctacttagcatcatggatcggacttccgtcgccgatctttgccgggattgcagctatatttgccatacagccctctatttacaggtcttttcttatcattattgatcaggttcaggcaaatatcatcggcgctgtcatcgctacggtattcggactgattttcggaccgagtccgattatgatcggattgaccgcagtgattgtcatcacgatcatgttaaaactgaaaattgaacacaccatttcgattgcgctcgtgacggttatcgcgattttagaaacaccgggaaacagcttcctgacgttcgctctgatacgaacaagcaccgttattttaggcgtgctgtcttcttttattgtgaaccttgtgtttcttccgccgaaatacgaaacgaagctgactcatcatacggttgaatataccgatgagatcatgaaatggatcaggctgacgatgcgtcagtctacggaacactcgatattgaaagaggatattgagaagctgaaggaaaaaatgatgaagcttgatcatacgtaccttctttataaagaggagagaagctactttaagaaaacgacgtatgtaaagtcgcgcaagcttgttttattcagacaggcgattattacggcaaatcgggcgcttgatacgctgaaaaagctgcaccgctatgaaaacgagatttatcatatgccggaggaatttcaggagacgctgacagaagaaattgattatctgcttcattggcacgaaaggattctgatgcggacggtcggcaagatcaaaccgcatgatgacgatgctgaagaaagcataagatataaacagcttttgacgaagtctttcttgaaaaatcagcagaactgcgaggatgaactgcttgattacaatatgctcagcattatggctgcggttgcggaataccgcgagcagctggagcatctcgatacgctaattacgagttttcagacataccacccgaaagacagcgaattagaaacagacgaagagtaacccggtgcttccgtaaaaccgggtttttttgcattcaaaaaacgtatgccgcccattcggacggcatacgtttttgtatcagttcaaattctgaatcgtaaataagtgtctgtactggccgccttgggccattaattcctcgtgcgtgccggtttcgacgacggcgccgttttccatgacgacaattttatccgcgtgcgtaatcgtggacagtctgtgggcgacgataaaagtcgtccggtttttcgcaagcttttccatcgcttcctgaatgtagtgttcactttcaagatcaagagccgatgtcgcttcatccaagatcagcagcggcggattttttaagaatacacgggcgatcgaaatccgctgcttctgcccgcctgacaatttgacgccccgttcgccgactttggtttcgtagccttcggggaagttcataataaattcatgggcatttgccgctttcgcagccgcaaccacctcatccagagacgctcccggtttaccgatagcgatattttcacgaatcgtctcactgaacagaaacgtatcctgaagcaccattccgacttgattgcggaggcttctcgcttcataatcgcgaatatctgtgccgtcaatcagcaggctgccgccggatacatcataaaaacgcggtatgaggctgacaagcgtcgattttccgccgccgctcatcccgacgagcgcgacggtttccccttttgtcacctttaaggaaacgtcctgcaaaatcgtttcttttccttcctcataacggaacgagacatttcggaattcaacttcacccttaatgccgtcagcttttaatgcattcggtttatcagtcagttcatacggctcgtcgataaattcaaatatgcgatccattgaagcgatcgactgggtcagcgtcgtcgatgagttgatcaatcttctgaccggattgtacattctgtcaatatagccgacgaacgcaaccatcgtccctaccgtcagcgggccgtttatgacaaaataacccgcaaacgcgataacaagcagcggcgccaaatccgtaatggtattcacaactgcgaacgttttcgcgttccaattcgtatgacggatcgctttgtccagaaaatgtccgtttttttcatcaaaattggcttgttcataatcttcaatggcgaaacttctgataacgggcatcccctgaactctttcgtgcaaatgtccctgaacttgggcgagtgcctgagaacgctcacgtgtcagttttcggagacggccgtaaaagtatttcactgaaattccgtataacggaaacaaaatgacagatatcaatgtcagcttcacatcgagtgtaaacataatacagatgacgatcagcaccgtcatcatatcaagccagatattcatcagtcccgttatgacaaagtcttttgtctgttcgacatcatttatcacccgggaaatgacttcgcccgttctcgtgttggcataaaacctcaggctcaatttctgaatatgatcaaacaataccccctgatatcgtagagcacccggctgcccgtccattgtgcgaagtattgccgatagtactctaccgggggacgcagaattaaaaacagcacgaacatgatgcccattatcgtgaatagcgatgatgttttagcgcttgccgttccgctcccttgaataatgtcatcgaccacgtattttaacagaagcgggagagccagcgggatggagaattttataatgccgattaacactgtgataaaaatttgttttttataaggttttacaaattgcatatagcgtctgattacgcccacactttatccccctctctctttaaggcgtgtgagcccatgtgaaaaacctgttgacaccccaacaggttttttattgtattctttattttgtatagcgcagataccgttcataccacatatcaacaaattccggagcaaacggtcctttccgctgatgaatccaatgcagcagcgtattcagatactccttcagaatgctgtcgatctctttagggtaattcattgatttgcggtggtcatcgtattcatcctcgtcaagaatgttatacgtcatatccggaaacaccttgacatccaaatcgtaatcaatatatttgatggcctctccgtcataagcgaacggcgagctgatgttgcaataatagtgtaccccgtcatctctcagcattccgatgacgttaaaccactgacgggcatgaaagtagcagatcgccggctctctcgtcacccacgtccgtccgtcggattccgtcaccattgtccggtcgttggctccgatgatacacaattccgtactttttaaaatcgtcgtttcattccaaattcgatgaagcagcccgttatgcttatagctgtgaatttgaatggtttctccttccttgggatatcccatatttctcccctactttctgtaaagccctgcagtcaatgcagccgcaattgctttccgacaagtcttttcactattataacgttacgaattaaaaaatgaaaataaaagaaccactccgcttccggaatggcacattcatttctgcacataggaagacggcttttccgtgctgcgataagactggatgacttgctctgtctgcctttggaataactcctgtatgccggccaggtcttttcgctttgtcgcaatttcgtcctgtacattgtccagctttgcatctctttccagactgatgagttccgcttccacctgccggcagcggtcaagttctgactgcagctcgagaagctgatccatgattttcatctgttcacttacaagcttttcaaactctgacatcgggttcctccttaggctttaggttgatactccttaccatttcgattttacgccggaaaaccctttgactcattctgtagaggaatcacaagttttgtcgttttagcaacagaaaaaagcacttccatccgaagatgaagtgctttttcgtttcagtgattagctgttttgctgtttgttttgttcagcagattggttttgctttctaacctgctgcgcatcagtttcactgccgaattcagtgccgtattgaccctgaccggaagctgattgctggttttgtcttttcacctgctgaacgtctgttttgctgtattttgagtttgccattgttatcacctccacgcactttagaatgcgcaggagacgataaggctattcatctttttttaaaacttatacgagcagagagcgtccgccgtcaataatgatggtctggccgcggatcatgtccgcttttgaagaaactaaaaactccaccgtgtcgatcatatctttaatctcgaccattctgccggccggcgtattttggcgggcatcttccagcagttcatctctgttagggaaatgcttcagcgcgtccgtatcaatcgctccgcctgacaccgcgtttacgatgatgtttttcggagaaagctcaaccgccagataacgggttaacgattctaaagcggcttttgagacaccgaccgtcgtatagttttcaagatagcggatgctgccgagcgagctgatgctgacgatgtggccgcctccgtttttctccatcatctttgccgcttcctgggcgcagaaaagcaatgctttcgcgttgatattcatcgtccagtcccagtgtgtttcttcgagttccataaccggtctcagcacgcctgaagccgcattattgacgaacacgtccagtctgccgaatgtttcgtcaatctggcggaacatgtctttgatttttgccggctggccgacattagctttaataacgagcgttttaacgccgagtttttcaatttcttcggcggtttctaatgccgcttttttactgcgggcgtaattgatgacgatattgtatcctttttccgcgagtctgatggcggctgctttcccgacgcctcggctgcttcccgtgatcagtgcgcatttattttgttccatttttcctcagctccttgctgtgtatagttcttttcattcaacaaacaataaaagcaatatctgttgaaaggggtcttttatatgtatgtcggacgtgatatgggcgaattggccatgatgcccaaacaagattggagagattcagagctcgcctatttccatcatgccttccagcaaattatgccgtatttaaacgaagaaggccagtccaaataccgggaactgattcaggaaatcgaagcccgcggcggactgaaacggaatgaagcggattacggccacggcactcgcgtcagctatgactgacgctttttagcggccgctttcttccgccattttccatatcttttgatgggaaacgggaaatgcgtattccttgagctcctcttttgtgacccgtatgaattccgttgtatccgacacttgttttactttaccgaaaaagaccgaaatattccagacgagatgggtgaaaacatgttctacgatgccttccagctccccgatttcagcggttattcccatctctttttctaaataggcttcaagctgctctctttcggttttgattcctttctgggtttcggtattcggaaactcccacaagttggcgagcaagccttttggcggccgtttatgaatatagacatcgccttgttcgtctgtcagcacaacggctgccattgtttttattccgggctttttctttttgcttttaacgggcagctcccgctctgtcccttccgcaaatgccgaacagtgcttttgtacggggcaaagcaggcatgacggtgatttcggggtgcagatgatcgcgccgagctccattaaaccctgattgaattcagatggtttttcatgagaaatgaaagcggataccgcctgttcgaaaatggttctggttttaggttttgcgatatcgtcccatatggaaagaattctcgacatgacacgcatcacattgccgtctacggcgggaatcggtttgttgtatgcgatgctgagcacggcgccttttgtataagggccgacgcctttcagtccgccaaattccttttccccggcagggacgactcccccgtaccgctcatgtacttcttttacggcactttgcagatttcttacacgggagtaataacctagcccttcccaggctttgagcactttttcctcatcggcttcagcgagcgccgaaacggtcggaaattgctcaacaaaccgccggaaataaggaatgacggtatctacgcgcgtctgctgcagcatcacctctgacacccacacccgatacgggtcctgattttctctccacggcagaattctctgttctctttcgaaccatgtaattaagtcctcgcgaaatttgtctatatctttttgtttcattttttcttcaagtgcgttcatatcttctcctcagatgtttcgggttccgcttttcttgacactgtattttggtgtaaactaagggcacgttacgataatatgttacattaaatagtgataaagaaaaagcggaaacatatgagaacggcggataaacgccatgattgggcaaacagaaaatggggaatatcttataatgcgaaatatgcgggcggctgatttttaacgcctgctaggaggtcaacaatggatactggcactcacgttgtcatgggtatcgcgcttggcggaatcgcaactcttgatcctgccgtcggcatgcacaccccaatgtctcaggcagttatgatcgccgcgcttgccggctctcaggcacctgatattgataccatattgaagctgaaaaataatgccgtttatattcgaaatcatagaggattcacgcactccattcccgccgtattattttggtccgttctgattccgggcattttgtttatgttttatccggaagcgaactttttgcacctgtggctgtggacgcttctggctgtcgttttgcatgtgtttgttgacatttttaacgcgtacggcacacaggccatccgcccgttttcgagaaaatggatcgctctcggtttaatcaatacctttgatccgtttattttcgtcagccatttggccgcgattgccgtttggtatatcggaggtcatccgggcgtgacatttctgatgctttatatcatccttgcaggatattacgccgtccggtttttgatgcagctgcggataaagcgaaggctgcgcgaaatgattgaagaggagattgaaaccatcattatttcgccgacgatgaaattcaggcagtggcgtatcgccgtgacgacggcccatgccttttatgtcggcagaagccttgacggccatgtcgtgatattggatacattcaaccgcgtgcccgttccggaaaccgatgtgatgaaggccgcgaaacaggacgaaaatattgcagcctttctttcattttcccccgtttacaggtgggaggtcgatacttttaaagatcattatgaggtgcgctttattgatttgcgctaccggagcaaaggccactatccttttgtcgccatcgtccacctcagtcatgatttagagcttctctcttcctacacgggctggattttcagcgaggaaaaactgcagaaaaaattaaagctcggctctgtttaagagccgggctttttttgtcttctcacatataatgcggcaaacacgaggctgatcaccgatagagcggccgcgggtttaaaaaacggcgggtaatacgttaattgaatatcgttttttcctttttgcgctttaaatccgataaaggaataatccgctttttcaatctgttcttttctgccgtttatcttcagctcccagcctttttcatatggaatcggaagcatgatatacggcgcgctggttttgttttcatacgagatatgaagcgtatttccgcgccatctgagatcggcccgcggttctttttccgcttttcggtatgcgtttttcagcgtatcgtaccgttcttcgtaaagcgccagcctgtcaagctgatacgatcctttcggcagacggatttggatgttttttgttttcggcactctgacagtaagatcgttgacacctgttttgtaaatggattgattcgattttctcgttgtcgtgtaatcgttcacttttaatgtaaagccctggtccttcgctttattcttcaaataaaagctgacgtaataatcgccgccgtccatcttagcggcttgcggcgtaatgatcaggccgccgccgtcttcatttaccgtcaggatgccgtcttgataatccgcatggtcggccgttacctttgcctgacggatcatatttttcgcctcaggcgcttttttcgtgttggctgcgcttgattccgtgatgatcccgtcaagcattgcccgttctctggcaagggagggcgcttttttcagaccgtcctcgttatatacgcgatcagctgtccgtacgaacggaagcatatattgattttgataaaccgcataatgggatgattccatgatttttttgaacccgtacggcacgccggccccgtttgttttttccgtcatataatattttccgtaaagcaggctgtataaattagccctgtttcctaatgtcgcataacggctgacgctttccctgcccatgtcaatccggaggtcgttccagtaaaaggacagcagattgcggttcagtatgcttgaatatacgctgaatccgttgaacccgtatatgatcggagtgttattgaaaacaccgttcatccaatccaaacgggcaaacggatcagggtctttttctttcaggcgctgaataagctctgtttgttctttgcccttatagtcaggacccgtcataaaggtatgcgataccgtataaatcttcccgccttctgataacgcatatttttcatatgtattagccgtcagcaccgccgtcaagagaatgacggcatagacggcggacaccgcgcctttcagtcttgtctttgctgcaaggaaagcggcaatggtcagccccagaaggagcaggataggcaggttggcctgatcagaaatatccaggctgaaccgtctcacttggctccaatagagcagaacggcgagtacggcggatatcagcatactcttcatgctgatgtctgaaagcttagaaagccctgctgcaaccgttccggcaatcgtgaagcacaggacgtattcaaacctgttttgcggagctgaaaaaccgttaaaggcgcttgccgcaaacggactgaagtgaaacagaatgtacagcagactgattcccgcaaacagccggaacagccggtttttatataaagaaaatgtaaatagaaaaagtaaaaaaaccgccggcagaatgattatccggcttgaaaataaaatgttgtcggaaaaatcaagccatgcaatttgctctgaatacggcggccgcagattatgaagatatccgtatacgacagggataaaggaaactgcgcttatgccgaacccgagaaggcccgacagaataaatatcctgcattgagcgagccttttcgcctcattgccttcaagggggatcatccacctgaataagatataaatgccgatgaaaatcagattaatatacgcaaaataaaagttgttgatcaatgtcagcgcacaggcgaagataaaccacgccggctttttttccctgatgattttttccgcgccgagcacgagcagcggcagccacaccatactgtcagtgaaaaagtcccaatacacctcatgccggaagtagataatcgagaccccgtacaacacggcgccggcaaaagcaggcaccgtccgtttgacgaaatagcggaacacacacgccgccgtgaatatgatgaaactctgcttggcgatgctgataaaaacggaggcctgcgcccaaaacagcgcatcagcctcacccgtcagctgaataagctgcaaaaagcggacagcggcggagataaacaggaatagaaaagaagtagagaaataatagccgagctgactgtacactcccccgcccagtccgaacgaatagctgtaaaacagcctgccgttcatatattgatcaaacagcagctttttgaagaccgccatttgggcgatcccgtctccagaccccgtcatatagcggccttccgaccactcttttaagaaaaaaatatgagcggctgccgcagccagcacacaggctgccggcaagatccatttattttttttcatacaacgtccccagaccctgcgcacagcggcggctgtttaatggttccacttgcgcttttttgtataattcgtttcattttgttctccgtacgttatattcgcttctttaattaaatagtgcgggcgtttttttgtttcatagtaaatccggccgatgtattctccgatgatgccgagactcaaaagctggatgccccctaaaaacagcacggcggaaataatggtgaagtatccgggtacggacacgccgtgtgtcagaatatgaacaaaggtcgttacaatataaaccatcgacagaagcaatatcagaataccggtgaaaaagcataccctgaggggcttgttgttgaaggagacgacaccgtccattccgtagttgaacagattgctgaatgaccatttggacgtgccgttcttcctttcgacattttcataaaatacgattttctggtcaaacccgatccagcagaacagccctttcgagaaacggttcccttcactcagcttcaaaagggcatcaacggcctgccggctcagcaggcggaaatctccgaccccgtcacgcaagtccacttcgacggctttgttgataaatttataatacagggaagaaagcacggaacgcacggggctgtccccttttcggttgcgctgcgcgatgacttggtcatacccttcttcatagccttgaatgaagtctttcagcagatgggtcggatgctgcagatcggcgtccatcacgattaccgcttcgccctgcacgtgttcaaatcctgccaaaatggccgcttctttcccgaagttgcgggaaaaagatatgtatttgacgcgatggtttctggcggccagttctttaatctgctgaagggtgtcatccgcgcttccgtcattgatgtagaaaatttcatagtcataatgaatcgtctgaaattctttttttaaagattcatggatgagcttgacgttgttcccttcattgtaagacggaataataattgagattaacctttgtttcatgaaggcaccttctttgtattattctttttttaggacggccttaaaggaattgtccgcaaaacttcagtaaggcttttcctttttttaatgacgtttaaaccctttttttgttacagggaaagaaatttttttctgcatatgatttatattttgtcatgtttttcggcagatatgagaaaaaaaagaaaaagtctgtacgcgggacagactttattgctgaaggtattcatgaatcaaatggctgacgatgcgcggtttttcgtgaatgacccaatgtgaggcatcatctatgaagattaagtcgccgtttggaatcatccgttttgtttccttggcgagctttttgctcagcgcgcggtcgttgacgccccatattaaccggtacggaacgggcattttaagcggaacggcagggcctaaaccgccggctctgatcgcccggtaccagttcagcatcgccgtgagcgctccttttctgccccatgcttctttgtagctgtcgacatcttcccgtgaaaaaagcgccgggcgttcagataagccgatcgcgtgatccaatacgcggtaatcgtcttcagacaatctccgttccggcttttccggaagctgaaagaaagcgatataagagcttttcttccactgcggcgggtagaacggtgtgaccttccgcataaccgccgggtgcgggatattgaccgtgatcaatttttcaacgttttgcggccgcgtggatgccaaatgccaggccacggctcctccccaatcatgtccgatgacgacggctttgtcatctgtaaaatgagtgatcagcccgataatgtcgtctctgagcgtatcaatggtatagttttcaatgccctccggtttgccactgagattatagccgcgctgatcaggcacgacaacatggtatccggcatccgccagcggtttgatctgactcttccagccgtaccagaattccggaaacccgtgcagcagcaccgccaaaggaccgtctttcggaccggctgaagccgtgtgcagcgtcactccgtttgtttcgatcatgtgaaacgtaatgtcattcatcgattctcctccccgtttgtttcaatcttctttctgttaagacgatgatcagtacgctgatcgcgatcaacaatacggcctgaacgatcagggcgaacggctgagtcagccggataagcaggctgcccgcaaatccagctgccgccgaaataaggccgaacagaatcatgaggagcgcactgaatcgattgccttctttccactgcgactcatccgccatagagcgcttcgtccgatatccgtacaggctgttgatcgacttcggcggaaaaaacgtgactgaaatgccggccgcagccatcagaaggccgccgattaccattatcatatccgtcactctccttttcatcttttacgaaaggaaaggcgaaaggtttcagaaaaaaagcaggcttattcgcccgcctgaatctttacttttgagttaagtcggccgtttttacataacctgctttcccggcgtatgtgacgtacgcccatttacggtcaaatcctccgtcatggctgaacccccagccgagcacattgacggtttcacccgctttaacagacccttttttgccggtttccaaagtcggcgtataaaaatcggtttgtttcgcggtcaccgccttcaccggctgcttcatcagaaaatgcgtggaaatataggctttgtgacctttgtagtcaatttcagcccaatctgctccttgaagccgtttaacctttacggaatcctctgaacgaagcgtgccgataatccgcccttgtttattgggttctttgcggacgttaagttctcctgctttcacgatatatgtatctgctgcggtgtctatttttgtctgatgaactgctgcggcattcgctgccggatcaaaaaaaacggtgcctgcggctaaaaataagcaaagtcctgcggccggaataaatgcggttaacccctttttcatgttcattgtggttcctccccgctattttataagttattacacatttccacattccgccggtcgtcaaacatgattttcccatttcttttataaaaagaaaaaaccgccggacggtatccggcgggcgcactgctatattaatgcaggagacccctgctttgatccaaataatgagaaacgtcttcccgaacgctttggaacatatggagcttgctgccgtatgattcgatccattccttgacgacgcgttccgtcatttgctctccttggtacgggcggccggcttttgcgtaagtcgcttcgaaatctccccataaaagctcaacccaagtccgcgcttgcaaatagctgagcatgtcatttttctcaagcagcaaattcgtcagtttgtcgatatatgtattcatgtctctgtctcctttccttgggaaaacctgctgcttttacgcagcttgtcacaggcatatactaactttacgtcttcagtccagaaggcgcaaccttttgatattggccgagggggaaaacaaatggtccggaacaaggcaaaaggatttcctaatcagaacaataataagtttgaaggcgaaccgcgggcaaaggatgactacgcttctaaacgggcggacggttcaattaattcgcacccgcaagagcgcatgagagcttcaggcagacgataacacacaccgtaagagaccgggaatgacccggtcttttttttgcggaaaaaaacatcctcttgcggtcataacgctaaataaattccataatatgttaaatgctaaaccgcaagccggtagacaaaaaaggaggggttttataaaatgaagacagtttcaaaacgattgctgagccttaccgcattcttactgtcagtttcattatttgctgtttcagcagaagcagcgggcagcccgcagacatctgtatcaaacagcggtgaggagtttgacgcaaatcagaatcagcctgtacaaacaacacagacatcccccgcttatgaaggaacgggcctcaccaaaagacagcttgcacaaaacagcaaagctgacatcaagtcattaaagccttccagtattattgggacagacgaacgaatcagaatttctcccacaacatcatttccatatcgcgcgacagcacagctgaccgttacatacagcggcagcacaagcacctacggatgcaccggtttttttgtcaatgctgacacgatcgttacggcgggacattgcgtgtatgatcagaaaaacggctgggcatcgaaaattacggcagctcccggccgcaacgggtcatcgtacccgtacgactcttattcaggcaagacattctacagtgtcaaagggtggacagaaaacggtgacacaaactatgactacggcgcaatcaaagtaaacgggtcgcccgggaatactgtcggctggtacggctatcggacgaccaacagttccagtccggccgggctttcctcaaccgtgacagggtatccgtgcgacaaagtgtccggttccatgtggtcggacagcaagccgatacgttctgccgagacatataaactcacttacacgacagatacgttcggctgccagagcggatcgcccgtttaccgcaattacagcgacaccggccagaccgccattgccattcatacaaacggcgggtcgtcttacaatctgggaacaagggtgacaaacagtgtattcgacaacattcaatattggtcaaatcaataaagcttttgtcttctttctcgcggcagccgttttatgcggatgcggcaaagcggatgattccgccgccaaaaaagcactgcccgttacgctccatgttgagaatgcagacggttcaccggcggccggtgtgacggttaccgtgatgaaagcggcggagtcagatcatcagccgaatatagaccgcggagagataataggcaagactgatcaccacggtgagatgacatggaaaagcggcgcgaaaggaacctatgccgttgtttttgaaaaagacggggtaccggaaacccggaatatttccttagctgagagcgataaacatacggtgatcagcattacgttgaaacattgaaaaaagcttgcaggcggaatatcccctgcaagctttttgttatcctttatgcacttggtattcataaacatctttcttctcagacagatgagcgaacgtggaaagcacaaggccgagagccgtcatcagcgcaccgccggcaaacagccatgagtaagatcccgttcccccgagaatcaatccgccgatccaggcgccgagcgcgtttgccaggttaaaggcggaaacgctcaccgcagcggcgattgtcgtgccgttttcagaggaggaaataaccttggtctgcaaaagcggcggcgtgccgaacgcacatgcgccgaacaaaaatgtcgctgaaacggctgcggcgggaaaaacagcgatataaggaaaaatcgccaagacgccgatcaggccgatcatcacaccgatcatcgtgcgcgtcagcagtttgagcggcactttccccgcgaagaaattccccgccactccgccgagaccgtaggcaaataatgcgcctgtaatgccgactgtgccgaaccccgctgaatctcttaaaatcggctcaataaacgtgtaagcgataaagacgcctgagtagccgagaatggtgatcgcaaaggaaaaaatcacttgtttatgcttaaagacactccattcattcatcagcatcggaatcactttcggttttcggttcggtacgaccagcatcagtccgatcagcccgatcaggcctaaaacagaaataatgaaaaagacggcccgccagttaagggcatcccctaaataagagccgaacggaacgccgagcatcagcgccacggttaatccgccgttcatggaagccgcggcggcggaacgtttttcaggcggcaccatttcacttgcaaacaccatggcgatcgcaaaaaaagctccgtgaatggatgcggataaaattctggaaatcgccagcacggcgaagttcggcgcaaagacgctcatcaggttggcaagcacgaagatgcccatcaaccctagcagcaccggctttctcggcagcttaaccgcgataatagttacgatcgggcccgtcaggcagacgcttgccgcgtacgccgtaacaagcatgcccgctgaagatacatgtatatgaaagtcatcggcaatcgacgtcagaatacccataacagcatattccgtatacccgatggaaaatgtgcaaatcattaaaacaaaaatcattaatttcacagatggctgtttcattttgatattcaacgcaaatcgcctcctttttattaaaaaacaacgaattccatcttaaaagatatcaaaaatgaattcaatcattttttactgaaaggttgaaacgaatgtgcccgaaaagaaaaagaggccggaaccggcctcttttgttattatttttcttttaaaacggaaatcggcagtgcttcttccccgtcagacggggaagatctgtgtccccaggcgaatacgccgttgatgtaatcaatgcggaaagtgtcatcagaaccttctatctgatacaccccgccgggccgaaagtcttccgggttcagcatgtaagctttggccatcgtaattttccgttcaagcacggccagttcatttacaatgcccatctgttccgctttacgcgctttttccgtcagtcccgcaatttctgtctgtagttcatgaggcgtcatttgactgtatcgtttgtccatttcagtttactcctcttcctgcaagaattgatcaatatcgtcaatcgagaatccttttctgaataagtactgtttgaccttcattccgctttcatagctgccgtcatagcggtatttcctgatcgctttttccgcatgagccttcagagcttccatctcggcttcatcatcattttcatactccgtctgctccagagcggcattgatgacgtcgaaagggaaaccttttcgctgaagctgcatctgcgcccgctgtctgatctcttttgtggacagctttttgtcttttttgaggattttgccgatatgtttcagcgcttcttgtatctgctcatcaaatgtaaacgcgctgagcgtctccttgatggtatcgtcgtctattcctttcgctttcagctcgcggaacaggacgtcagggcctttgccgtttgtttttttgtgggtgctcgcataggcttcggcaaattctttgtcatttaagtagcggtaatcgtacagtttatggatgacttcagaaatgaccatgtccggtgtttcttttttcttcaggtgatcccggacttctttttcagaccgcatccgatatgataaaaattcaacggcgcggttaaaggcttttttcacgtcatcaccgtgctggatttcaagaatgtcaagctcgtccagttctttcccttttttcaggtcaaaacgcacaagcacgtcggcgtcgacgctgaatgcatatttctcatcaagaaagatgttgaagcgctcggtatttttcttttgggtcgatatttttgtaataaacggcatcccggtctccttccccgccccgatgttcaggcgtttttctttttggcaaatgaggtacagtatatgtatcaacgtgtaaggagagatggatatgaatatcgcgatgacaggcggcactggttttctgggccggcatctgacaggtgtgtttacccgccgggacatcatgtctatattttatcaagaaaacagagagaaaccgaacaaaaaaatgtgacatatgttcaatggctggccgaaaacgcggcgcctgagcgcgagcttccccctattgatgtatgggtgaacctcgccggcaaatccatctttgaccgctggacggacacaacgaaggaacaaatcatttcaagcagaatagaagcgacgagagaagtcagacggattatgaagcagcagccgaaaaaaccccgggctttgattcaggcaagcgccgtcggcatttacggcacaagcacagagaaaacgttcactgagcagtccgatacgtcaaatgaagactttctcagtcatacggctcatatgtgggagcgtgaaggccagaaaattgaagcgctcggcatccggacggtatatgccagattcggcgtgatgctcggtgaaaaaggcgccctgccgctcatggttctcccttataagctgttagcgggcggcaccgtcggctctggacggcagtggctgtcatgggttcatgtcgatgacgccgcggaacttattgcttttgcggcggagcatgatgacttgtccggtcccatgaatgtgacatcgccgaatcccgtagaaatgaagcaattcggaaagacgatcgcaagcgtcctgcaccgcccccattggattcccgtaccggaattttttctggagaaggccttgggagaaatgagcctgctgatcgtaaaaggccagcgcgccctgcctaagcaggcgctgacatccggttttcagtttacgtatgaagaacttgagttggctttaaaggatatcttatctgcataaaaacggaaataaaagccaatcctattggtattctgttttgaaggagggtcttcttttatggaaaagaagcgcgaaaaacatcagcagggagccaatctgaaaaaaatgcaggaagtcctttattccggtgaatttaaaaaagcggaaagagcagccaaacggaaataaactgaataaagatcggggccgggcagatactatgtttgtttgatatcacttttttcagggggcgattgatatgggcagaaatcatactcacaaaaaccgtgataaaaacaaacaaaaacttcctcaagttccggatgctttgaaacgcgaaacagacggcacgtacgaggaatattcaagcgagcttgctgattccgctgaccgcgaagcgcaggcgcggatgaaagccgctgacaacagagctaaaagcaaaacccgctaatacgaaatccccgcctctgtatagagacggggatttttttacaactcggtaaacaggctttttgccggcgtccgttctttcgccttaggctgttcatccggatagcccgtttgaatgatggcggcgaagcgctcattgtctgccagaccgaagtcttggtgcacctgtttgtcatacatgatgcggccgcttttccagaccatgccgatgccgttttcatgtgcgagcagctgaaggttttgaatcatgccgctcagcgccgcgaaatcatcgtttctcgtaaattcattttcatcttcttttaagacgacaagcaaaaatcccggaacggcgctgaggttttttctcatgttccgctctttttcctcgttgaaatcatcttttatttttttgaaaaatgagacgtagctgtccgcaagcttttctttacccgcttcgcttgctgcgtagataaaacgccatggctccgtcagtctgtggttcggcgcgtaaacggccgtttcaagcatatctaatatgacttcagaaggtacggtttccggcttaaacgaccggatggatcttctgtttctgattgtatgtgcaagactttcgttttgctgtagttgttcggttttcggcatgccgattcaccttcctattcaattgaaaatgattatcatttataatataacggatacgaccgtcttttgtaaaccgttacggaagctgaaaattgattgattcggcatacacggccgttcccgtcatctcgattttcatcttttcgttatcttctgtaatcctgatttccacttttccgtctttcccgatttcctggccttgttcaatcgtgaggcattcggcttcagagcctccgtattgccgcatataggccgccataacgcctgaagcggttcccgtgacgggatcttcggtcgttccggagaaaggggaagaaaaatggcgtccgtgcagatcactttccggatgaacggtttccagagaaaacggatgaacgctcgctttcggaagatcgcgcaaaacagcggggaattgtgcgttgtccggcaccatattccgtgatgcttgaagtgatctcagcggaacaatcagtgtccagatccccgttgatccgtaaacaatcggcagctcgctgtgaaaatcctcagccgtaatcccgagcgaggccgcaagcttttctttgtctcccgtaaacggcagaaattgcgggggtgcctgttcgagcgtgatgtatacccggccgtttcgttcagcggcttttgcgggaagaataccggcttttgtctcaatttgatatgtctgatcagcctgaagccttcccttttcaattaatgcgtaaagagaggcgacggtagcatgtccgcataaattcatttcgtggccgggtgtaaaatagcggatgcgcagatcggcttctccgcttttgcagagaaatgaggtttcattgtaccctgccatttcggcgatcatctgcatctcttcatctgaataatcatctccgttaaagacgattcccgcgggatttcccaaaacaggaatatcggtaaacgcttcatatttaaacacggttgcctgtttcattcatcagccttcctttcaccttatgatcatgttattcagtataacagagtaaaattagaatttttagttaattcttcaaaaaaaaagacgccttttaacggcgtctttttttggtttttccgatcaggcgggtgacgagaatcatcgtgacggacagcgatctgtttttacggtacgccaagtatttcccgcgccactccggtttgtatttttctttaaaggcccgcagcccgctgaagctgtacatataccggacgttgttgaaaatgacggccgcgattctttccgaccagaaagatgtaaaagccgttcctacgtttgacaaaggcgccatgcccatattaaaggtggtatagcctttttcctgcgcccagagaaacagacggataaaaagcgcgtccataataccgttcggcgcacttttccgataacgcatcaagtcgactgatatctcgccttcctgatacatcggcatcaggttggcaaaagcgatgatctccccttccgcgtctttcacgtaagcaatcggcgcctgttccagataatcccggtcgaagaaaccgagagaaaaacctttctcttttttcggtccgagccattcgtccgatatgtctttcagcttggcgataaactcggaggaaaacggcggttccccgacatgaaatgtgtagccttcgcggtcaaatttgttgttaatcgcccgcagccccgcttttttcttacctgacagcgtaaatgcttccatatccacgaacgcctcttctccgagcttgaagaagttatagccgaagtcatggtacagcgccagatcttcacgttcgatctgataaaacatgacactcagcccctgcttatgcgcttcattcagaaattcctcaatcacaagcggaaaagagtctctctgtcctgacggatcaccgagcacgacaagccttctggaaatctggccgaacaataaaagcgctttgccgtcgcttgagaaataaaaccgcttatccccgagaaagccgagatggctgagggcgtttccgccttcttccgccaaaaaggacttcagccgttcagggtcggccttttctccgatcggcttcgatcttttatgataaaagaccgtaaacaacaggaaaaacagcggcacaacaataatggccgtcatcgtggcatatgtaatgtgcgaattgttatgaacgaaataatcgtggcgcagcagccgattcattttatcccagataaagccggcaatgagattgtagttaaacaaggcgataataaacagagcggccgcaaaaatcatctggccgagcgtatacgatgcctgctctctgataaactgccgctttaacagcaccagcaatacgatgacgacaggcagaataaagatcgcgctgatgttcaatccttttaaaaaactgaacacaaaaccgccgaccagcgcggcaaccgccattgaataagaacgtttcgtccgtttgtataattcaatcggcaagattaaaagaatcaaagccgcgcttaacgataacgcgttaaacgcaaggagcgccgggcgcggaatatgcgggatgaccgtctccctgtcaatcggcagggcgacggatgccagcacaacgactcccgccatgaaaactaaaagcgacagcgaaccgtaaagcactctgattaagatggcgcgctggaatacgagaagcacgttcgtcgtttccacggcgggcgccatcttcggatttgattccagccgtttaagcgtattttccgttaaatcgccggccgcaaagaacagcccgaacacaaacggaataaatgaatacacaatccggtagatgacgatggatgtcacaaccgcctcctgcggaaagcccatattctgcataccgagcagaaacagaaggtcaaacgaaccgaatcctcccggcacaaggctgatgattcccccgatagcggcaatggcaaatacaccgaatacatggcggacatccgcgtgaatccccatgacatacagggaataatacatgacgacggccgccgcaaaccattcggcaaacgatgccccgatgtaagaaaaaaccggatgcctcggttttgcttcaccgtcttctgcgcgagcttttttattgttgacccaagcggcgattaaggctgccggcacaataagcgccactccggcgattacagcccacagccacggtttctcacctgtaatctctccgaccggcagaatgcgggcaatggtcaggatactgaagacggacagcccgagcagcgctgaggacgtaagccaggcgatgcctgcgacaaggcgttttacgtcattcgtatgctctttgtaaagcatcgtccgcagcccgacgcccgccagaccgccgaatccaaggacattgttaaaggaattggcgataaaggagaccctgaatactttccaattcggaatgtcgaggcgaagcgtccgtttcagcacaaagtcataaaaggacatcgcgctgacggcaaggagaccgagcagaacgagaataaataaatcgtaacgctcaatcccgttaataatatacagcgttcgtttaaaagaaaggtctgtcaattcctttttggactgataaatgactaaaagcaaaactgcaataggaaataatacttttaatatcgataaggcattctttttagtcagcaatgttctctccaatcatcataaaatagcttatttattataattcccccaataatctccaacatattatacactaccacctcacattcaaacaaaactcgtctgcaactttctttctctgattaaaatcagtaatatggtatgcaggagtatgaatgaggaagtgagacgatggattataatctgcatgatacaacggtattaggcggcgatattttttctcctgaggaacgggatatttgggtgctgtacatgaaagtgatgacctcggcgggactcggcgatgtgtcggagtggatgaagcttgatatgagcatgccgcaaatgaaggtgctgatgcttctgaacaaccacgggacgcttaaggtgagtgacatagcggagaaaatgggcgcttctctttcaaatacgacggggctccttgaccgtttagaaaaatcatgtttcattacacgcgctccgtcagaagaagaccgccgttcagtcgtcgttcaattaacggaaaacgcgaaagatattttccgcagcctttatcaaaaaggacatgtaaaattgaagcgttcattggaaacgctgaccgctgaagaaaaacaaacggtcaatcaaggacttgccatcttggcaagagcccttgattcttccaaacaggcatagagatgaaaaaggcctgccggtatcggcggcctttttttgtttgacatttaattcacttgaagtgaataatatattcgaagtgaattaaaaaaggaaggattgatcagtatgccggatccattgcaaacagaaaaaaaccagagccgggccatcactctttttacgatcggtgtgttcatggcggcgctggacaacggaattatttccgctgctctgacgacgattaacagctcttttgatgtttctccttcatggggatcatggggagtgaccctttacacattgggactcagtgtcagtgtgccgattgtcggcaagctgtcggaccgatacgggcggaaaaaactgtttatgatggaagtcggcctgttcggactcggctctttgcttgtcgcactcagtcagagcttcccgatgtttttggcggcacggctcattcaggcgcttggcggcggcggaatttttataatcgggagttcgcatgtgctggccgtgcttccgaaggagaaacaggggaaagctctcgggcttttaggggcgatgaacggtatggcggccgtcctcggaccgaatatcgggagctttttgcttgatgtaaccggatcgtggcattggctgttcttgattaacctgccgattgccgccgctttggttgtgtgcggcggtttgtttatcgctgaaacgaaagagcctgaggcgaaacggcttgatctcgccggcacaatgctgctgtctcttgcgatcttatcttgtatgatcggtatcacgaatctcgatgggacgaagctgtcagaaagcataatggacgtaaaggtgtatgggtatcttttgggagcggcacttctctttctggtgctgcttaaggtcgaaaagcgggttgaataccgcgggggcgatccgattctcgcctactcgctgctgcaaaataaagtgtttcaatggacgcttgtcatcggatttttatcgggagggctgctcgctgcggtcatttttattccttcttatgcggagcaatatttacacgtatcggcggagaaagcgggttattggatgacgccgcttgcgttggcgtcaggcatcggagcgtggctcggcggggcggtcacggataaaaaaggaccggtcttctccgcggttgtatcaggcgccatcgcctttgcgggcttcagcctgtttccgttatgggtgacggataaatgggaatttgtcacggcgagtgtcattgcggggatcggtttcggatttctgctcggggctccgctgaatgtgcttgtatcagaaacggcgggccaaaacaaaggaacagcgctcggcacgctgtcactcgtaagacaggtcgggctgacgctcgctccggctttatatgccggcttcattacagcgggctttgaccggatcggagaggacattaaaaaccgtttaacgaaaagcggcattcccgctgatcaggcgcaaacgcccgatatcggcggcggactttcttcgttgcaggagcaggtaagccgaatccccgttcccgccgtcaaaaaagcggtttctgatgcgattgaagcgggcatttccagcggctaccaccatctttatacggcagccgccgtcatttcattatgcacgattgtgtctgcggctgttttggcgtttttccggaagccggcatcctctaagacagatgccagcccatccgccgggaaagctcagtaatatgggcgatgtgatgttcagagtgccagacatatagcccgagcgcctgttccagcgtaaccgtctctttagatacaggatggaagtatgtccgtttgaattgggcttccgtcatggagcgcaaaagagcggcccatcttctgtgcaggatcgttaacagctcaagcgcatccccgcaagcggcggttttggaatcatgaagagcggcccagcctttttcatcataggacggatttccggttcattctccgttaagctcaatttaaaccgggtatagccgttcatgtggctgtccgccagatggtgaaccacttggcggacagtccatccccttcgcggtacggcgtatcaagctgactggccgacatcgctctgacagcttggttcagtttagccggagcgtgttccagcgcattgatccattcttgtttctgtccggccgaaatcgattcagccggctgatactctccaatcggatggctgagggtttgtttttccatttttgtctctctcccgctgctcgtattatgaaagtatgatggtgatgtcgcagccttccgctttcgcttcacgaaagacctcaagcacactctcggcgccattttctgtaagctgcttgctttgttcaaactgtctccattctaaaacaagggggtactccacccatccggtcagacagtcccataaagcgtcaaggttttcaccgtagtactcaggaagggcaagttcctttttcaatgtctggtgcaggtcgctcatacttctgatttgctccccgttaataactgctttattcatgcgcggctcctttctcatgattctattctatcagtttaccattttcctcttcagaagtgaccggagtctgccgcggttccagctggacgatgccttgcccgccgtcaacggccaccctgtccccgttttcagttttgacgttgcatttccgcacccgacaacggcaggaatccccagttcccgggcgacgatcgccgcgtgggacaaaggggcgccgacgtccgttatgatggcagccgctcttggaaaaagcggggtccagcctacattggttgtcgacgtcactaaaatttcccccgccgcaaaagaatcaccgtcttccggagcatcaaggacacggacaatgccctccactctcccggccgctcccgcgaaaccttttaaagtatgcgcatcatccgtttccgcaggcataaaagcatcgtaataatccgctcttctgtcaggatcctcagcccatttaaacggattgaatcttccgttaataacggatggaaacggcggcagttttttataggtttcatagttttgctttctcgcttgaatcgacgcaaccgccggctctttccccgcgagcagatcggttatttcatgcagatacaggaagaaaatatcgtccttcatgccggtcatttccgccgctctgagcgcgaatgctctggctgtccggtacactctgacaaattcggatctggttgtttctctaatattcgcgtattctgacgctttttccattttggctttgagccatttgaccttatgaggaaactttttttcaaatcttcggaaggcctgttcatgcgcccgctgctgtttcaaaagcagttgttcggcatcaatacccgactccttgtgttctttgatctgcttcgtcagccaatcccggttttctcccggatgcggtatggaaagttcgtattcatgcgggccacggtggccctggttcctgagatattcttcctcgctcatacggcctttcatgacttgatcaatgccgataatcggctccaggctggccagtccgccttttcccctcagattggaaagcaggagattcgcatcttctatgcctgcgagttttgttaattgagaggttaacgacgaagaggattgcgcagaatcacgcccgccggatattaacgcaaaccacgcgttgcataaatacggatagatctcatcgttccatatcgctaataatgcctgctccgtttcggcgcgtttcagcttttcctcaatattccggcaccactccggtgattcgtccaagtaggaggacatgttttttttcgcttgcttcattttcgacagatacggtttcagttttttcgggatgatcttcaataattcatactttgagaacggatataaaggtatcttcatttccgccgggatttctcccaatgtatcgctcatcatttttccaatttttccgcctttcggattcagaccgaaagcggcgagaacggaaagaggctggctcatattgttataggctctgccgcaaatattgccggaccagacataatagcccggaatgatgcccgactcttcatccagattccggaggagcgaccatgtcagcggcgtcatcacatcgggaatcgcttctcctatatttgtgtttgtccataaaaaatcaccgctgaaagaatcgttccattcataggtttccagatttccggcttgtaaggtcgtaatcgggcgggattgaagaatatacaatgtcccgcccgcggcggcccattcaatatcctgcggccctccaagatctttttccagctttttcgccagtttatagagctttgacgcatatttgcgaaattccccggggccgtcatattttttcttgggccgtgccagtttaaaagaataggcatcggcttccccggaaacgagctgctccccgagaccgtagacgtaattgcctgtcatctcccgcctgctccccgtaatcggatctgcggtaaacagcactccggatatctcagacggtatcatcagctggatgacgattgcgatttcatgctcatcttccattccctgaacggcgctgtacgcttttactctttctgactgtaccgaccggcggacttcatcaatcgccctggacatgtcttgatctgttctgacattcaacaccgtatcgaattctccggcaaaggaagcctgagcggaatcctcgctcagcgcggatgagcgtacggcaaacaacgcagatgcatggcggctgcggatggaattcacatattgatcaacagcctctctcgcctgatggcggagctgtccgtcctgaaaggctgacggcaaaatcacaaacccttcaggcacaggatacccgctttgatacattttagagagaatgcttccttttcctcccgcaaaggaataaagttcggccggaagttctccgaatgttttgacacagtcattcataatgtccccgctcctttttagtcgttcatccaagctcacagtttttctctttttcactttttttgaaagtatttcctataagtatacaatatatcggtcttcacaagggagaaaatcggtggcgttattttgtcataaatgcatccgtcaaaacagccgcaggcgggggctttgtatgcaggatgtacaactatccgtcctcgtgccggataaagcggacccgtatcaaaaaggcggccgaagcgccgcctttttttcagactgtgcggccttgatgcgccgccgtatttcttttggtctgcttcggctgatacactttcccgacaaacaggtatccgtatctgaaatggttgcacccccacgatacgaaaatgggacctagcgtgcagatcaaaaataaaagaaggatggcagccgctaaaggcattgaccgcaaatagccttccagaagatatccgctgattaaaaagtaggagtgcagcagatagattgaaaacgaatagttgctgatcatcatcacaatcgcgggcacttttttgagctttgaaaacagatgaaaacacagaaagatcatactgaccgcgtaaatcataatatccggacgcttagaggaaatggagccgccgctgatatatgaaacggccacaatcaatattgccgatacggccgcactgaagtaaaccgcataacggtactgattgatgagcgataaaaaacgcggatattcctttccgcaataaaatgccagacagaaataaaacacccagcccggaaacggaacccaaaagaacggaaaaatagaatcaagccccgatgatgccggcggatgaaagatggaaaagtaagccagatagacggcgttgatgataaacgaaacagacagcacccacacgggggatgtgttgttcagccagcggtgcagcagcatatggagaatgtaaaattgaaagatcacaagaatgaagtagccgatgaagtttcctaaaaacacattttctaaaaatttaccgatcactgaaacgaatccggctccttcttccgccacgcttttcattaaaatggcatccaccgcggcaataaacagaaacggcacgaaaatgactttgccccttttctttaaaaaacccgctggaacgcctttcgggtatgacctggcaagcagaaattccgaaataaagataaacgccggcgtgctgaacatcaagagggtccgaaacgcatcaaccgtatgggcggcactggctaaggactcttcctgaatcatcagcaccattgaaactgcgtgaagcagaacgacacttaaacaggacaggcagcgaatcacgaaaatttcttttatctgcatgcggccgctcctttttcacaagcgcgccggactttggcgtatgcttggcgcagccatttttcccgcagttcgggtgtgctcgttctgacgacagaaaaaaggttccgctcggctttttgaatgccgcaaaattgcagaatgctttttttcagcgtaatccagtccgagtttttccggaaccactttaagtaccagcccggggagtccgccgtataaaagacctgtgccgtctctgcccggagcagtccttttacgcggccgttttcatatgtgtaggcttctccggcgacaagcactctgtcaaaaaagcctttcataatcgccggaacgcctccccaccacagcgggtagatgaaaatgagatgatccgcttctttcatcagtttccggtatttcttcgtttcagcgtcccggttcatgtcagagcgctttttttcgccgccgtacttcagcacgggatcaaattgatcggcgtataagtcaatgaccgtatagctttggccgctgtcctttaaagccatggcgacgtattttacgagagccgcattgaaactgttctcatccgggtttgcatacacaatcaccgtcttcatatgtccctcccagtatttattaatttttacaatgattatatcatgatgtcatatgaatgaggcaaagacacgagaaaggctttttccagttctgctgccgtttcgataacccctttctgcatatttttgctgattttggcgccgcggattcaatgataagcatccggtgcttctgcgtttttgagcggccgtatggtatactagctgtcaaatgaatgggcttggaggacaacatgagaattttaaagtacgcgattttagggcttttgcgaaaaggcgaattgagcggatatgatatatcgagctattttaaggaagagctcggccagttttggagcgcaaagcacagccagatttatccggaattaaaaaaactgacggctgagggatttattacgtttcgcactgcgattcaaggaacgaagcttgagaaaaaaatgtacacgctgactgacaagggagagctggagcttgctgcctggctgacgaaaaaagacccgattccggaaacggtgaaggatgaatttatgctgaaggcttatttcatctcagctttgacgcaggaagaagcggatgagctattcaccgatcagctcgtaaagcggcaggagaaattgtccgatctggaaaacagttatcaagaactgatgacatcgtccgcggaggcggattcattttcttctcctgatttcggccattatctcgtgctgacaaaagcgcttgagcgggaacggaattatatttcctggcttgaagatattttggctctcatcaaaaaagcataaacaaaacggggcggctctgtatctgcaggccgcctgtttacgttctgaggaccgcattgataaacgaatcagccattaaaataagaaaaagcagactgaaataaacaatcgaataaaaaaacatccccttcgaccattgcgtgtcatccgccgcctgaaagcctttgacgctccggtacagccagatggccccgagcaggagagcggacgcggtataaaacgggctgacgtctatataaagaggaacgagcagcgaaaccgcagtcaaaacggcgatatagcgcagcatttttatttttgtgacgcgattgccttttatgatcggcaaaagcggaatgccggcggcacgatactcttcctttcgcctgattccgatcgcccagaaatgcggcggctgccacaaaaacataatcgcgtataacaaaatcgcgggcatatcaatgtacccggccagcgcgcaataaccgattaaaggcggagccgcccccggaaagctgccgacaaatgtgctccagacggattgtcttttaaaccaaagcgtataaacgacggcatacagcaaaaatgcaagcaggccaagaacggcggtcagtacattaagcgaagcaagcatgatgaatccgcatacgccgagacatgtgccgtacaggaccatgaccgtcggcggtattcttcccgtgacgctggcgcgggtgcgggttcgctccatctttgcgtccatgccgcggtcaaagaagttattaaaaacagtgcttgacgccatgactaacgccgtgccgatcatggcagccgccatggcggcaaatataccgggccctccgtccgtcctttccgactgaagccacgcgatccaaaatccgcctaatgcggcgagtgaatttgagatgataatccccggtttggcaagaatgataaagtccttgaacgtcatccggtttccgttatgcttcatagactgttccgtctgtgctgcatttgaattcatttgtggaggttctcctttttcggcttatcatatcaggaagaatcaggaagtacaatttattttgggcatttttcacacaattgtaaattgtatatgaaaagccgcatcttgtgaccggatgcggctcttccctttttctattcaaagtctgcccatacagctccctgatccgccgaacggacacccattttcaatccagcggatgccctgagttcgggccggcgatggcgggctccacgcgtcatgtttgcgcctcactgagatgttcgctctcttcagtcacacaaaagccgggtgtatattgcaaatcgacgttcttctttcccgagcctttagaaaaataaaaacccttgccggttagacggcaagggttgtttcttacagtgtaaatgcgatatccgccctgatacagggtctttgacgaatacgccctcttctctttcttcgatctcaaagccggcatcggtcagcgcttttgtcacacgtgacagctctttttgatgcggcagcgtgatggtgtaataatccagcccgcttgcatttcccggtttcggcggcgcatgttttccggcccatatattcagaccgatgtgatggtgataccctcccgccgaaacaaacagagcggacatgcccgcgtaattgccgacaatgtcaaaaccgaggatatcggtgtaaaacgctttggcttcctgtaaatccgtcacatgaagatggatgtggccgataacggttccttccgggagacggcttttccgttcagctccggcttcttccaaaagcccgtccacatcgacgggcgccgtttgcatgacgtaattgccctctgcatcccggcgccacgtgctgcggggacgatcggcgtatatttcaatgccgttgccgtccggatcagacaagtaaagagcctcactgactgcgtgatccccctgcccgagcgcgatgccgttttcaatcagcctggccaatgcgatgccgagttctttccggtcaggcagaagtatcgcgaaatggtaaaggccggtgacagaccgctccgggagaacgacggcgctcggattttcttcaagcaccagcaggacgcgttttccgtctgctgacagttctgcagaacgatctgtctgcgagatgacttgaaggccgatgacattccgataaaagccgagcgagcgttccatatttttaatcgtcaatttgacataaccgattgctgtatcttgatgaatgccggtcatttgaacgccttctttcttatgctgaaaaagtttctcccttttttgatttgaaaaggagctgatccaatgaaagcagacggcttcctgaaagcgctaagtgaattgacgcaaccagtaagatgaaatcaaattccgatccgcccataaatggtgaggaaagcttcgccgtgaagatggcgccgactaatgtgacggcaaacagaacgccgataatgcgcgtcgccaaaccgaaaaagatcagtaccccgccgacaagctcaatcgtcgcgatgacgtagaccataaaggccggaagcccgatgctctggaaaaattgcgtagttccttccaacccttgaaacttggataaaccgtgaacaaaaaagataatacctgttacaacccttaaaagcagtgttcctgtttcgaatgatttattcataaaatcctccttgaaaattattatcacttactttatgtaagctagtatatatacataacttatttacgtcaagtaattttgttacatttaacgaaaataacttaaaagtactatttgtcttcgcaaaaaaaagacctccgcactctgtcggaggtctttttccctacctatgattcccggaactggctctcatataattcccggtaaaacccgttctggctgagaagttcggcatgggttcctttttcagccatttcgccgtctttcagcacaagaatctgatcggctttttgaatcgtgttcagcctgtgagcgatgatgacgcttgttctgcccgccattaaacggccgagcgcttcttgtattttcacttccgtcaccgtatcaatgttgctcgtcgcttcatccaaaatgagcagcaccggatccgccagcacatctctcgcgatggaaataagctgtttttgtccttggctgatgcccgcgccgttttgggtaaggacggtatcgtagcctttcgggagccgttcgatgaatccgtgggcattggcggcttttgcggctgcctccacctcttgatcagatgcatccagacggccgtaacggatattttccctgatggtgccctgaaagagaaaggaatcctgcaggacaaaccccatgttttttctcagactggacctcgtcagttttttgatgtccgttccgtcaatgaggatttttccgttattgggctcgtaaaaacgggcgatcaggctcgtaacggttgttttacccgctccggtcggtccgacgaaggcgattgactgtcctttcggaacgctgaaggacagatgttttaagatcgggctgtcttcctgatagccgaaggagacatctcggaattcaatctctcccgttttgatcggctggtgcgtcgcatgctcttcatcttcccgctcctctttttcatccagcacgtcaaacacccgctcagccccggcgatggccgataacatcgtattgaactggttcgccaaatcatttaaagggcgcgtgaactgccgcgagtattctgcgaatacgacaatggaaccgatcgaaatccaccccttcagcgcaaacagcccgccgaccgccgctataatcgtaaagcttaaattgtttaaagagttcatgactttcggaatgaatcccgaaattgtctgcgcccaaaagcctgatgattgtaacgccgcgtttttttctaaaaattgctccatgacgcggtcttccctcgaataggctttaatgaccttcgctcctgatatcgactcttcaataaaaccgttcagctcgccgaggtttttctgctgctgcttaaacaggagtcccgtccggttggtgatccatttaatgctcaaaagcatgatcggaataatcaaaagcgtgatcaatgttaaaagcgggctcatgaacagcatgacggcgattgtgccgacgaatgtaatgacgctcgacagcacttgaatgacggatgtatttaaagtggagctgacattttcgatatcattggtaacccggctcatcaaatcgccgaggcgctgtttatcaaaaaacggtatcggcagctcatgcagatgggtgaacagctcgctccgcattttaaacacggtgctttgcgagatattgatcatccaatagttttgaaaccataaggacaatgattgcacgaggtaaatcccaaacagtatgaacagtacacccgccaatccgtccgtcgtccgtccgacgataaaatgatcaattgctttcccgatgacgaacggtccgagcaggccgaatatggcgcttatgactaccatgatgatcacaagggttaaaagcccttttttctcggctacatacgaccagattctgcgcagcgtgccttttgtatcttttgctttcgcgcgttttctgccgccttcatttgatttgagcggtattttcggatatcggaaaggtttacgaatgtctttctccactgtcagctccctcctttccgaattgtgattcataaatctgccggtacagatgagactgtgccatcagctctttgtgcgtgccttttgccagcaattcgccgtcttcaagcaataagatggtgtcagccttcatcgcggtggttattttctgcgtaataatcagtgtcgtgcattcataggatctgatcgcttgtaaaagcttcgcttccgtttgaagatcgagcgcgctcgtactgtcatctaacagcaggagggacggctttctgataaaagcgcgcgcgatggaaatccgctgcttctgcccgcctgacaaattgacgccccgctgtcccagcaccgtgtcgtacccgtttgacagcttcataatcgtgtcatggatttgcgcgtctttggccgcttccattacttcatctagtgaagcttcctcccgtccccaggcgatattttcacggattgtgcccgaaaacagaagcacttcctgcggcacatagccgatttccctgcgcagcccgcaagcggagaattcaccgatcggtttgccgtctatgaaaatactgcctgaatcagccgtgtacaggcgcggaatcagctgaaaaagcgttgatttccctgaacctgtcgcgcccataatggcaaccgtttctttcgggctggctgaaaaggacacgtgatgcagcgcgtctttttccatgtccggatagcggaaggacacttcgcgaaactcaatcccgcctgcaagcgcccgcgccgggtcgtgccccgttccctcgccgccttctgtttccagcacctcgccgattctttccccggaagccttcgcccgggaaaataccataatgagaaatggcaggacggacagcgcgcctgtaatccgcgtcgcatagttaatgacggaaacgacatcgccgacctgcgctccgccctgagcaatgcttttggcgccgaaccataagataaacaaaatgcagctgttcatcagcagcattaaaatcggcatcgccgcttccacgagacgaaaagcggaaaccgttttttccatcagcttcgtattcgatttcaaaaaacgtttcacttcgtggtttgcacggaggagcgctttaatcagtttgatcgccgtcaggttttcctgcatgatcgtgttgacctgatcaagccgcttttgcacggaccgaaacagcgcgccgcctcttttcagcacccacagcaaaaacaaaagcaaaaccggcaccgtgatcagcagaaaaaaaccgagtttcgcattgacggtcagcgagagaataatgcccccgcaatcattaacggcgccctgagcataaaccggagactcatgaaaagcatattctggacctgcgtcacatcgtttgtcagcctggtgataaacgacgtagatgagaattgcgcaaacgtcgaataagagaaggattgaattttttgaaaaagcccttttcgcgtatcatacgcatagctctggctgatgtgggcggagtagaatgaatttaaaattcccgatgcgaatgaaacagcggtcagtccgatcatcaccccgccccacagccaaaccgtaccgagatcctgctttaaaattccttcgtcaatgattttcccgatcagcaggggctgtatcagctctaccgcaagctcgatgagcatgaaaaacagagcgattcccgccaaaagggaatacggttttacatatgataaagcctttgacatgtgtaagcctccaaatcctttgttcaatattattattttatgcctttccggcaaatgaataaagaaatttggtgtgccgttttttcaataatctgcgaaaaagataaaaccttcccggggaggggaaggttttgaccttattgatccaattgctgttcaatgcgctcccgcatttgcggaacgcctaatccgacaatgacctgaagcgccctgccttttctgacgacgccgtgggctcccagctctctgaaatcggcgtcacttttgacctttgattcatcagcgacagtgacgcggagacgggtggcgcaattggtgacctccgtaatattgtcctttccgcccaacgcttcaatatacaaagcggctgtatcccgctgtgtttcgtctgccgcagccgtttcttttgaagcctgcttccgttctctgtactcctttttcgaatagagctttgtttcctgcccttcctctttttctctgcccggtgtggcgatgttgaatttgagaatgaggaaacggaagacgaaaaagtaaacagcggtaaaacacagcccgatgatgatctggtatacatacgtcaaaccgtggcttgacgccagcgggatccagttcaaggtcgcagcttcgatcaaaccgcctcccatatttccgacgacgcctgccatatacatgacggttgccatggaagcggcaagcaaagcatgaaccgcaaataaaaacggcgagataaaaaggaatgtaaattcaatcggctctgtaatcccgctacaatggacgtcaaggtgaccgggatcaaaaggccggcgacgatttttttcttttcctttgaagccgtggcgtaaaaagcgagcgcgattcccggaatgccgaagattttcgagttgccgtgaagcgcgaagcccccctgcgggaacaattctttcagcggtttgacgctttgagagtattccccgagatgctgggcccaataggtgacgataccgccttcagccacagccggaccgtaaataaacggcgagtaaataaaatgatgcaggccggtcggaattaaaatccgctccaggaatgtgtaaatccacacgccgatcgccccggaagaaacgagaaaactttgcagcgatccgattccggactgaaccatcggccatacgtatgccaccgcaagtgaaatcggtatcataatgaagaaagaaatgataacgatgtaggaagatccttgaaaaatccccagaaaatccggcagttttttatcaaagtaacgattgtgcaaatacacgacaatagatgaaataaagatggcgccgataatattcgtatcaagcgttttgatgccggcgatcatcgtcagcccgctcgttccgccggcttcctgagtcatatcgacatgaaaagccccgccccaaaccgtcagaatcgcattgataaagtaattgaatgtcagataaactgtaagcgcttccaaacaagcccgcgcctgcgcttttttcgctaaggcgacagggatgccgatcgcaaacaggagcggcatttgattaaagacggtccagccgccctgttcaatgacgtaccagcattgataccaaaacccgtcaggatcagccagcggccccatcagcgttttatttttaaacagcgtgctcagaccgacaataataccggaaaatgcaaataataaaacaggcacaaacatcgcgctgccgaagcgctggactttttgcatcatttcacgtgacctcccgctatttatcaaaattttcgagctctttataatcaacatatgcacggaataacgcttcgcccaccagaaaaaacggggcaaatgcgacgatttccgttttatcgcttaacgtcaccggcttgctggtcgcataaagattatacggcgtcgtttgcgccagtacgttgtttttcagattggtgattgaaataaacggaactccctttgcggacagggtccttacctgcggaattaattcgggtgtttcgcctgataaagaaataatgatgaatacgtcatcaaccttaaaatcatcacacatgatattaaactctgtgatgtcctgaattaaaatcagatacttccgccgggatacaaacatccgctgcagctcacgggcgcacaccctctgagccgtccccgatccgtaaacgaaaatccgttttgcttcatctatcagccggcacatctccgtcatatcttttgacttcacgtattttacattggcttcaatatcatccagcagcttttcaaacgtcatattctcgccctcttcaggctgatcctcccatttcagaaaaacacggaattcactatagccgctgaagcccagtttttgggcgagccgcaggatggaagaccgagagacattacaggctttcgccatgtcattgataccgagatggtagcacgtatgtttatgattcaatatatattttaaaatataaaaatcgttgtcatttaatttcgcgtaatgctgattaaccagttcttcaagactcatcccaaaaatccccccgttttctttctattatatagaataacagataaagaaaacggggaagattgtcatcaggaaataggagacgggcttacatcaagctcaggccagtagtccttattagcctccatcagatcttcaagaatcagtcttgccacacgggcattcggcactgtttttgacaggatcagcgcctgccacagcttttgaaatgaccgctcttcccacgcttcagccgtcagtttttcgacagacacctgctgttccatcaggcctttttgaaattgcggtatgttcccgactgagagcggttccggtccgtttgaacctacgagacaaggaatctcaaccatggctgacggatcaaagtttgcgatcgcaccgttattttcaacgattaacagcattctctccccggtgttataagcgatggcccgggcaagatcgacgatataggaagcatgatcatcaattttaatttcactgttctccgatgattgttcgcgcgtaatcatatcgcattggctgaaaatgaaagcttcgcgcccttccatgacttcgttggctctcgtatggttcggatttgattttttcaccatatcatccgggaataagtaatattgcagatatgtgttcggaagcgtatccggatcagccgcctgtacgtcgcgcgcttttttgaaggtgtcattccagcttgcttcagtctgttcggcctccgtcttcggaacgtagccgtattcacggacatgctctttcagcttcggcattaaatcattgccttctcgatccgtgatggacgtccaccagccaaagtggttcaagccgtagtaacggacgttcatttcttttcgtgaagataatccgaggatgttcgccatgcgatcctcaattccgaccggcatgtcgcagatgttcaatatttttgaattcggtctgaggcgccgtgtagcttcggccacaatcgccgccggattggagtaattcagcatccatgcgtcaggcgagtacgtttccatataatcaagaatctccagaacaccgccgatagagcgcatgccgtatgcgattccgcccggcccgcatgtttcctggccgaccacgccgtacttcagcggaatttgttcatcgagcgcgcgcatcgcatattttccgacgcggatatgcgccatgacgaagtcaacatccgtaaaagccgtctctgggtcatcagtcgccaaaaattcaatgtccggcgctttttcttttatgaatacctcacacgcacccgcaatccgctcctgcctttctttatcattgtcataaagtttcagctttctgatcggaaactcttccaggtgattcaaaagcattaatacaattccgggggtaaatgtgctgccgccgcctgcaataacgattgagaatgatttgtctgtcatgtgaagccctcctctgataacgtttacattttatttatatcatgagaaggtccgatctgtaccgggtttgaaggagttagatcatttgatcatttttagttatttttctcaaaaagcgggaaagttcccacaggtacgaaaaaggcctgctgtcatcagcagaccccttctcaaaaatgctcttgtaaatcagaaagcagcacttcctgctcaaattgtggatttccgatcggaaaaatcctggctgtttccttgtcttcgttgacatgctgaatataaatcgggactccttcatacgtcacatacgccatggcggcggattccgaaatgtctttcgcacgctgtgtattcacgtctcaaacctcctttagtcctcacacataacgtgtccggcacccaagagaagtatgcttgtttcttacaattgtccggcggtgagtttgaattttttgaggcgtttgtaaaacgtgctccgcgggattccggccattttagcagccagcgtgacattccccttcgctgattcaagcgcgtttacgatgatgtttttctgaatgtgctcccggatggagacagaggacgcttcttcctgttcataagactcggccgcttctttaagacctgacgcttcaagcagggctgcgatggggcgccctgacagccgtccgtccgggaacatgacggaaagacgttcaaatacattaaacaattccctgatgttccccggccatttccggctctttaatacgtctaaaaagtcaacaggaagctcccccgccagccgcgatttcgctgaaattcaaggaagagtccgggaatgtcttcggtgcgttctcttaatggagggaggtggatcggacagacgtgaagccggtaaaataaatcttctctcagctttttgcattcgacaagctgtctcagatcagtgtgggtggcagtgatgattctgatgtcaacgggaatctcttttgtcccgccgaccggggtgactttccgctcctgcagcacccgtaacagagccacctgcatggagtgtgatatttctccgatttcatcgaggaaaagcgtgcctttatcggctttttgcaaagcgccgctatgtcctttccgtttggccccggtgaaggcgccttccgagtagccgaacagttcgctttcaatcagcttttcggggaccgctccgcagttgacagcgataaacgggccgtttttcctggagctgttgttatgaatcgcccgggcggcaacctcctttcccgtcccggtttctcccgtaagacaaacggttgcgtccgttcgggcgacaagctccagctgctcaagcatatgtcgggatgacgggcttttgcctgccgcaccatgaaatataaacgacggcttttcttcccgtttggataagtaaacgcatgtgaagccgttctcctcccgcttcgtccgcttgatatgatagccctgttcctcaagctcgcgcagcatatgtccggtaaaatgctgaacgggacggcttgcggcgataacccggctcatttcattgcaaagcacgatcggatcatgagaccgggtaagcccggcgaatttgctgatcatgtcaagttctgtcattttgatctttagggcaagctcccgttccgccgtataagcgatggaggaggcaattccgagcataaaaggctgagcgcgggcggcggggcaggaaatatcaatgacacccgccagccgcccgtcttcataacggatgggcgcggcggaacagctccattgatgagaagcgagcgaataatgttcagagccgtgtatcatgaccggttcatttgtataaagagccgtcccgatcgcattcgtgccgacggccgtttccgtccagcgggcgccttttaagaaattgatgcggttcgcttcatgaatggtgcgcgggtggccgtcaactgaatggacaacgccgtctgaatcaatcaggagaaccatcatttccatttcccgcatcgctgttttcattctttctgcgtgcggcattgaggccgctaaaaataacgcatgcttttcggcctgcctttctaaatgatctgccggcattacattcggtcccttttctagataagggttgacgtcggcttttttgcagcggtgccatgaggcggccacccgcttctgaatacgggattcatcgagcacgccttctttcacaaagcgcttccaggttttaaaatcattccgaatgacattcattgtattcgctccccctgttcagaccatcttttcatatattgtaggggaaaagtaaagcgctttcaacgaaaaataccccttctcatctgagaaagggtattccggttatacggaatgcaccgcaagtccggtgacattcagcagggcttcctgaagcgtttctgacagagtcggatgcgccgcgataaagtgctccgacatatccgccgtcatttcaccgttcatcatcatgaccgcctgaccgatcaattccgtcacgtccggtccgatcattgacaccccgacgatttctccgaattccggctcggcaatgattttcattttgccgccgtgctgatgcttaattaacgcttttccgttagcagaaaatgagcattctccgattttcacatctccgtatgtctctctcgcctgtgtttccgtcagcccgacagctgccatttccggcgatgtataaatacagcggggcaccgcccgcatattgactttgctatcctttcccgaggcatgcgcggcggctgtgattccttcatgaatggcggcatgcgcgagctgcattcctccggccgcgtcgccgcacgcatatatatgaggcacattggtctgcatatggtcattgacttcaatcccgcgcggagaataccggatgccggcttgatccaaattcagcccttgcaaacgcggttttctgccgattgcaaccaaaatgtgatcagcctgagcttcaatttcttttccgtcttttgtccacacggcggttttcctttctttgtcaatccgctgaagggcggcttttgtctgaatatcagccccgctgtctcttaaagagtcttcgaaaacggcggcgatttccctgtcttctgccgggagcagccggtcagccgattcaatcaccgtcactttcgttttaaaccggctgaataaagaggcaaattcgcagccgatcacacctcccccgacaatgagcagagacgaagggattttctgtaaagaaagcgcatctttgctgtcgattacccaatcgccgtcaaatggggcaaacggcagctccgccggttcagatccggatgcaatcaatatccggtccgcttccagaatgtcttttgcgcctccttcttcttcaacaagcaatgtctgctctgtgagaaatgaggctgtcccgctgatgactttaatctgatttgctttcattaagtattgaattccctgcacgagctggctgacgatttgccgtttgcgcccctgcatgcggttccaattgagtgtaatgttttgcggcagttcgatgccgaatgtatttgcatgcctgattttatcgagcacattcgcactttccaaaagcgactttgtcgggatgcacccctcattgagacaagtgcctccgagcggccctttgtcgatcagaacgacttctgctcctctccgcgcggcagtcacggcagctgcatatccggccggcccgccgccgataatggctagtttcattttttcacctctctctataaaatcaaaccggcaggctcttcaagcagcgctttgaccgttttcaggaagtccgcagccggggcgccgtcacatactctgtgatcaaaggtaagactcagcggcagcatgatgcttttgacaagctcatctcctttaaacgccggcgtttcatagcttgcgcccactccgagaataccggcttcaggcggattaagaatcggggtgaaatgctcaattccgtaacccccgagatttgtaatagaaaatgtcgaaccgtggagatcatctccggaagcattgccttcccgcgcccggcgtgccgatgtgctgatgtgatccgcaagctcaaggaatgaaagcttttccgcatcccggatcaccggcacgacgagaccgttttcaagagaaaccgccatcccgaggtggacatatggataggtgatgatccgctcctcttgataagagctgttcagctcaggatgctgtttcagcgcaagcaccgcggcccgggatatgaaatgtgtgaccgtcagtttaacaccgctccgctttttcgcgctgtcggcgagctgctgctgccattttacaagctccgtaatgtccgctttcatcgtcagcgtcagctgggcgctgttttgcaggcttttgtgcattcggtctgcaatcacttttctcatcgctgaagccggttttccctccggctgtgctgtctgaaccgaagactgcggttcagcttctgtcttcatcgccttgatgacgtcagcttttacgattctgcctccgggccccgtcccgttcagcgtatcgactttcaacccggctttctccgccatttttctggcaacgggagatattttcacgcggtgtttgcgcttttgcccggcttttggagcgggaatatgttcaggttcagcttgcggtttccctgctttttcaggagccggcgcctccttctcccgcacttcttcgccgttttccccgatataacagatgggcgttcccggcgggactccttctccctctttgactttaatgtgaagaagcgtgccgctttcaggcgcttctatttccatttctattttttccgagttgatgctggcgatgctttctcccttttctaccgggtcgccgacttttttattccagacggatacttcacctttcttcatcgccattcccagcttcggcattactacttttacagccattctgtatccctcctttaattcattgccggctcgccaagcaattcaagcgtgacgctgacaatttggtctggtgtcggcaaatattgatcttcaagcaccggcgaaaacggcaccggtgtatgcggcgctgtaatccgcttaatcggtgcatcaagcaaatcaaagcccttatcggcgacaatcgcagcaatatccgtggcgatgctgcagcgcggattggcttcgtcaatgatgatcagccggtttgttttttctaacgatgtgaaaatcgcttcctcatctagaggagacagactccgggggtcaagcacctcggcgtcgatgcctttctcagaaagctgtgcagccgcttcaagcgcggtattaacctgcttgccgaccgcaaacagcgtgatgtcgctgccttcgcgtttgatatccgcttttccgagcggaattgtataataatcttccggcacctcgcccttcatgctgtaggacgttttgtcttcaaaaaagaataccggatcattgtcttctattgccgccagcagcaaacctttggcgtcatacggattggacggcacaaccgtcttcagccccgggatgctggtgaacaggccatacagcgcctgcgaatgctgagcggctgcccggaacccggctccgtatgtggtgcggacggtgatcggcacttgcgctttaccgccgaacatatagcggaatttcgccccttggttaatcacttggtcaaagcacgttccgataaaatcattaaacatcagctcggcaatcggtctcagccccgtggatgccgcagccatggccgcacccatatagcccgcctcagaaatcggtgtatccagcactcggctgcgcccgaattcctgtacgagaccctttgtgaccccgagtaccccgccccatgcctcatcatcttgcaaatgatcgaccgccgctcccccggcgacatcctcaccgattacaagcacattgtcgtctcttctcatcgcaagcttcattgcttcattgatcgcgtccgacatgcttatgactctcgccatctcacattccccctttttcatatgacacgtagacgtctgtcaacagctcagactctttcggataaggactcttttcgctgaacgagacggctttttcaatcgattcgctgactcgctgttcaatgtctgacaatttatttgcatctgtttcttttagaagatagtttttaaagccttggatagcatccttttcttcaagatgctcagtcttttcatcctttgttttataagtttgggcatcgccttcgaaatggccgtagtttctgtaagtcatacattcaatcaaagacgggcctccgccgtttcttgctctttctatcgcttccccggctgcctgataaaccgctaaaatatcttttccgtccaccgtgacccccggcatgttgtaggcagccgcccgatcggcgattgaatcacaggctgacgcgtactcaaatgtcgtggcttcgccgtagccgttgttttcggcgatgaacacgacaggaaggttccatactgccgctaagttcagcccttcatggaaggtgccttggttattggctccgtccccgaaaaagcaaacgcttacatttttagtttgtttatatttagccgtgagcgctgatccgcatgcgagcgtaaatccgcccccgacgattccatttgcgcctaacatgcctttatcaagatccgcaatgtgcatagaaccgcctttgcctttacacagtccggtcgcttttccgaatatttccgccatcatgccgtccagatcacagcctttggcgatacaatggccatgtccctgtgtgtgcttgtaatgctgtcgccatcatctaaatgagcgcacacccccgcagctaccgcttcttcaccggcatacaaatggacgaatccgggaagcactccttgcgcgaaaagttcatgcactttgtcttcaaagcccctgatttccagcatcttttggtacatccacagcgctttttcctcagttaatgacaagccttctcgttttaacaattccattttgtgcgcctccttctatttagggttcacacttataaatgcaagaagcatgccagcctttgaagcccgtaaaatgaatgtttttattttttcaatggagacagtttgagacaggtgtctcattttgtctcgatccgttccctttgtctcgttttatggcatacaaaaaagaccgggcatcaccctgtctttgacaatgatcgacgtatttatttcctcggaaatcttttattgcttcattcttccgcatacagtctatcacggcgtttgagtggttacactctttttttcatatccacgcgctgcagttcatccttttcttcaacagcccgattcagtgcttgaagcatgtaaccaatgcctttatacgatgacagaggccaggtgatatgctgatgctctccgatgacggcgtttagaatgcttcggtattttttcccgccaagcatgacaagctcttcgacgtcggaaaagcctttttcataaaattgacggcgcagctcgtccgctgccatgatctccgggtgaccggttccaaaagtgacatcgtaatttccgggaacagtatcatccggacgaagaaatccgtgcttcgccgacaaaatcacccactcatcgaaaaatgctttcgcatatcgctcgcatgcctgatgaaacgggctgagataagcgtcttccgcccttaccggccctgtatctgaatggacatcccaaatttttttcttgccgcaggggatgatgcacagtcgtttcatttttctctcccctttatgatgtatctcctatcaatgtaccattattcgtttatttctgcatgacgaaaccggccatggatctgtctgggtaaaagctgcacacaaaaaggcccggaattcaaaccgaaatccgggccggatgatgagttgtttatgtcactcttgctccatcccatcaagatactttctctcaaagtcatcgagcaatgcacgcacttcatctgttgactttgtattcatgcattgatttcttaattcacttgctccccggaacccgcggagatatatcttgaaaaagcgggggagcggtttatatgctctggcttctgcttttgaatattcatcatgaagatccagatgcaatctcaaaagatcaagcaattccttactgctatgctctctcggctccttttcaaaggcgaacggattagtaaaaatgcctcgtccaatcataatcccgtcaacaccgtattgttcagcaagtttcaagccggtttcacggtcaggaatatccccattgatcgtcaaaagggtatccggcgcaatctcgtcacgaagtttcttgatttccgggatcaactcccaatgcgcatctactttactcatttccgctcttgtacgcagatgaatggaaagattcgcaatgtcttgtttcagtatgtgtgtcagccagccgcgccattcgtcaacatccgtgtagccaagtctcgtcttcacacttaccggcagacctcctgctttcgccgcctgtattaattcggctgcaacttcaggacggcaaatcaggccgcttccctttccattccccgccacattaggtacaggacagcccatattgatatccaggcccttaaaccctaattccgccattccaatactcatttggcgaaagttttcaggcttatctccccatatgtgggcaaccatcggctgttcatcctccgtgaaagtcaaacggccgcgcacactatccttcccatccgggtgacaatagctttctgagtttgtaaactctgtgaaaaacacatcaggtctgcctgcttcactcacaacatggcgaaaaacgacatccgtcacatcttccattggtgccagtacaaaaaatggccgcggtaattcacgccagaaattatctgtcataacaaatccaaatcctttcatgatgggatacagtgaaacctttatcccaaaattaaaaactgaccatgcttcttttacacttatagcatgtgtcagcacttcttatcaaacgatagtaaattttgaacatttcactttttacacgttaaaagtaaaaaagcaaactggagtagaacacattaattgagctaacgtaatagactaccgctatagtcaaccccatatcgtttatttctgatcaactcagtcaactccttcacctttaaaagggtttgagagagaaaaagtgtgatgattatctacacctaatttttatttatattgtggtttattaagattagcgctgaccttcatctttcttagcggccttacttttgctctttttggataaaaaggattccaacctaaatagaatatcatatgagttctccctattaccataaaacaaatttcaagaaataagttgattaagcaaatggggctggggggtatatctgagtactgaaaagaatgtaaaaagaaaaagccttaacttgccgcttgtgaatcacatggagtaaagaggatggcatgggaaaataaactcgaacttaacagaattcaagaacttcaatctggatcttttcggatttactcatggtctagaaataatcaacgccgcaagtggcttggctctatacagtatatgtactaagggttgatcggcttttaaaccccgtatgttaatatctttatacaatcacctatatatatttgtataaggttacgcttcggtaatcctgatccaaaaccaataaaatagactgctgactaagtgccgcagtcttcattcataagattaattagaaagtgttcatgttctttcatcattaaataaggcatcagaagttattgctttcatttcggatattctttgttatacctttaatgatttgtataacagtgaaaacccccaagaaaacagtgacaatattaaaccatggattatcatagaatgaaagatatgtttgaaagaaatccagttcagctatatttgctgggaatccattcatttctctataattaggaccccatcccgttaattctacaaagttaaaataaagctgtgatactaaaaatgccaacaacgtgtgaaaccaacttcttttatatactttacccatttctttatccatttccttttctgcaatactttttagcctagtgtcaatctaacatcattatatgatgaagcatgattgtcgcaataattacttattaaggatataaccatcgcaggtattactgtaatagttgttatcacttgcgtttccgccttatatttattcctttttttagaacaagaggaatagttggggtccttttcctgtttaggctttcatattatatataacgaccaaacatgcttttttagtgtatttgatcttttatcgacagttgttgatatgccaactgccgctgtgatttagtgaaagttagcacccttgccttttacagcttctacttcagaaccttcgttcagttgttgaaatctcaatatctctcgttcggtttcacctcctttttatcatttattaaagacctacttactttggcatgataaatactttacagttgaataatgttacaacttcatctcaaaccaatgatatcaaattattttacattatcccattaatgtcacaataaaccacagcgtcattatacaaacgaggtcaaaattggctgttttctcctcgcttttccacacgttttttcaactcttttcatcagtttaaattaaagatctccgagaaaagaaggaagataaacagccagggcaaaggctgcgcataaaaaaaaccggaaatcggaaatgtttataccgaaatccaggtctgattacgaattgtttattttagttagacgatttcaacacaagcttcgccacagcttccacatgggccgtctgcggaaacatatcaacaggctgaatatattcgacgcgatagtctttcgacagcgcctgcaagtctttcgccagtgtggaaggattgcaggatacgtagacgaagcgtttcggttttacttttttgatggtatctaaaaatgttctgtcacagcccgttcgcggcgggtcgacgatgaccacgtcgggacggaagccttctttcgtccatttcgggagccagtgttcggctgttcccgtgacatatgccgcgtttttgatgccgtgttttttggcgtttttcttcgcatcatcaattgattctttaatgacgtccatgccgcggatctcttttgcgccgcttgaaacccacatgccgatcgtaccgacgccgcaatacgcgtctacgactttttcttttcctgtcagctgagccgcttgtttcacttcgtcatatagcttgaccgtctgctcagggttgagctggaagaaggcgcgggcgctcagttcaaatgacacgtcaccgagcacttcttgaatggcatgtcttcctgccagcgcttttgttttgtcaccgaaaatgacggatgtgcgcgcgccattgacgttttgaataatcgatttcacttccggcagccggttctgaatggctttgacgatctcgtctttattcggcagtgtctctttcgcggtgacaagcacgacctgcacttcgcctgtttcaaaaccgactctcgtcacgatggtgcggacatcgccttttttggtccgttcgttataaacggatacgttgtgtttttccaaaatacggcggacgatacccgttgttttgtttgtcgccggatgctggacaatgcattccttaatcgggacgattttatgggaatcaagtccgtataagccggcaatgatgctgccgctttgcgagcgtccgacttggaactggcttttgttccggtaattccaagggttgtccattccgatcgtatctttaatgttcatttcttcgacattgaatctcgtatgacgttccagagactgaatgacgatgtcgcgtttttcgcgaagctgctgggtgtatgccagatgctgaagctgacagccgccgcactggtcgtagaccgggcatggcggcgtgacgcggtgttcagacggcttgcggatgtttttgacgcgtgcttctgaaaatttcggctgcacatttgtcgcttcggcaacgacttcttccccgggcagagcgccgggaacgaagacaacttttttcttaaaatagccgacgccctctccgttaatgccgagacgtttgatggtcagcggaaatgtctgcccgattttcaattcggcaggcgcctttttttgatgttgattcacgtttttttctctccgtttctatataaagcctttctcctgggaaagcggctgatttgaaatatcacatcttttcagtataacatgcagccggcggttccttcatgtttttcactggaagtttccaaaaaatgatcaaagcggtttttcattcaatacttctccacaaatataaggacgcatagcttaaatacggcgcccattcgctgcttacctgaagcatcacgtctttcgacggtttatcctcaagggcgaagcggcgtttgatggcattttgcaggccgatatccgccaaaggaaacagattcgggcggccaaggccgaacatgaggacgttttggacggtccacgggccgatgcctctgatggtgatcagctttttcataatgtcttcatccgataaatgggtaagttccgccagattgagcgctccgtctgcaatcatgcgtgaaatgtcaatcgcatattccgcttttctcatgctgaactggagctcccgcaagtcctgataatcaagcgccgcgatcgttttcggctcgggatagcaccagacgccgtctttttgttcaccgaaggcatggacgaaccgttccgttaaggtaaatgcgaaagacaggttgagctgctggtggatgatgcatttcatgagacagttgtagacgtcatattccaagacgagcggggttcccgcatgctcctcaaaaagcgccgacagatttgtttttgagaaatgatcaagcacaggctgaagcggctgttcccattgaaaaatgtgtttgatccgttcaatcatctcctcgcggtccgtttctccgctgacgaggaagaccgggtctgcggcggtgccttccgcttgaaccgtagtgacggacagtttgccgtcccgtgttctgagcggcactttgattgatcttgcatgaagatcgaccgcattcagcggatcgagcgacagcctctcaaggactttatcaaaatgatacggcggcgtgaccgaaaccgtttccttccacatatgctccacccctttttgtccaagtatatcatgaagcgggcgggcggcaattcgtatacttttcttcataacgccgcatgatataatggcaggcggagggttgtttatgatacatataaccgcaatcacaacacataatgagatattagataatatccccctatcacgtacagaacaaccggacatcgcatggtactggatcgattttttcggcgctgagatgcatgaaaccgagctgctgcgggattattttcactttcatccgcttgcgatcgaggattgctttcagcatatgcagcggccgaaaatcgaccattatgacggctaccgtttttatgtgctccacgccttgaacccggacacactggaaatggaagaggtggacatctttcagtccgaccgtttcatcgtcagcttccatttgcacgaatcgcccggcgtctcaagggtgagagaacggtttttcgcttctccgggattagccaaaaaagggccggggcacatcacttatatgattatggatcagcttgtcgatgaatatttccccgtgctgtacaaaattgaagaccggctgaatgaaattgaagacagcagaacacataaatcttacggcactttaatgaatgaagtgtttgaattgcggactgatcttttgaacctgagacggacgatcattccgatgcgcgatttaatgtaccggattttgagccttgaccatgtaaaagaaagccgtgaaacgaaggcgtatttcagcgatatttatgaccatctgttaaaactggccgagctgatcgagtcaaaccgtgatatgacgtcagatttgcgggacagctatgtgacgctgaattcaaaccggatgaacgccattatgatgacattaaccatcgtctcgaccatttttatcccgctgacgttcatcgcgggggtttacggcatgaatttcgataacatgcctgagcttcattggaaatacgggtattttatcgttttgggcgtcatggccgttcttgtcgccgccatgctgttttggttcgcccgcaaaggctggtttaatattttcaagtaagaacggctgccggctgttcttttttttgagaaaacatgatagtctggaaaaaaacgtaaagaggtgtgcgccgttaccatcctttctcataaaatcatttcttctgtcctcctgcttttcagtgtcatgtccattgccccgctgtataacggccgtacggtgtctgattacatctttgagtcgctcggcttttcttcctggtctgaagacggagcccatatctccgtcattcccggggtcgtcctttactttgcggcgttaatctggtgtgccgccgcgttcaggcggacgcttccctcggcggggctgtttctgatctttctcagtatgggggccgcttccggtatcagtcctgccaccgaatatgccgctttttccttaaaacagttcgcgcccgaaaaagagtctgtcgaatatttgaagcaccgcagcgaatgcagtcatctgattgaacgaaaaagagcgggcatgagctgcacgctttatatcaatcattacggaaaaggggaacaaaccatttctgtcacgccggatttatcagaaaacataaaggacgtcacattcaaatcaaaaacattcactgtaaaaccccgttcaaaaacaatcatcaaaacccgatttaccggattttataaggggacagccgcctcagactccggatggtcttcagaaccggaactgaaagtggcaatcctgtacacagcagaataaccattttgcatgtataatggtggaaaacttttcattggagggactgtcaaatgaagatcgccatcgtcggactcggcaatatgggccgccccatcgccgaaaatatcatgaaagccggatacagcctgactgtatataaccggacgaaagaaaaagcggctgacctgctggataaaggggccgaatatgccgaaacgccccgccaggcagctgaacatgcggacattgtgctttcaatgctgtcagacgatgaagctgtaacaggcgtgacgttcggagcttgcggcattattgccgggttatctgaaaacggcattcatatttcaatgagcacgatcagtacggcgctgtcagaacagctttccgccgcacattcgggcagagggcagtcctttattgccgctcccgtcctcggccgccccgatgccgccgagaaggccgagcttcgcatcatcacagccggaccggcagaagcgaagaaaaaggccgaaccgctgtttaacatcctgagtcagcaagtatttgacacgggtgaagaaacaaaaacggcaaatgccgcgaaaatcagcatcaatttcttgctcgtttctatgctggaggcgttatctgaatcattcttaatgatggataagttcggtttagaacaaaaacaatttctagaaatcgccaacgcactctttggctctcccgtctatcaaaattacggcacgatcatggctgaggagaaatttgagccggccggcttcaaaatgtctttagggctcaaggataccaatctggcgctcgccgccgcagaacaggtttccgcaaaactccctcttgccgaactggcgaagagccattttgaaagcgggatcgcacaaggctgcggagatttggattgggcggcattgattaaatgtatcaaataacaaaacacctctccattaccaggagaggtgttttctacaggcgcggcagcttcatttctttctcaaacatcaggtcatcaatgcttttaaacgtgtagccttcttttttcaaatcggtaatggcatcgtccagagcttctgaattgtcctttgaaacggtgtgaagaaggtagatcgcgccgggatgcgcctgctttatcatgtgatcataggcgtattgttttcctttttgctcgttaaccttccagtcgacaaatgcgacggaccagaaaaccgtttggtagccgagacgcttcgtttctttgaggacatattcgctgaatacgccgcgcggcggacggagatacaggttgtcccgctttccggtaatgttgtacacagcttccgtgacggaatcgagttcgtcttgaatctgatcgcccgtttttgtcgtcagatcaggatgatgaaaagaatgattgccgatgatatggccttcctttgacatccgtttaatcaaatcaggctgctctttcacaaaatgacccgtgacaaaaaaagtgcccgtgacgtgatgtttttttaacacatcaagcactttcggggtgtacccattttcatatccgttatcaaacgttaaatagatggtcttttctttcgtattgcccaaataaaaggcatcatattttttgaccagattgtccagctgtctgccggcatccggcggctgatgattgacgctgcgtttaaatccccagtttatccgttcattcggcaccgcttctgcgctgttgatgcctcctgcaagtaaaacggccatgcagcaaattgaacaaaaccatttcatgaccagcactccttctgcatttttccttattttgcagtaggccctgcccttttatacagccgcattatggaaaaagaaaaaccccggcatccgccgggggttattcccaatcctttttaaagcgttcgtattttgcttccagatcatcaagcatgccgatgagccggtctatatcttcaacgtccgttgattcagggtctaatgaatcaatgacattcataaacatatcgagtctgttcttcaggtaatcgagctgctgatctttgctgtttactgcattccccatacttccactccattcattttttataatggtagcgtattttttggcgtttttcaatggttccgctacttgcgatcttggcagatcaggtctaaaattaacagttggcagacgttagtatgcccatttataaaggagttagatagtcatgacacaaaacacagcactgcgtccgattacaccggagtacgatccttgggaagcgtacatggatgtcgaccagtatggagatatgaaactgacgaacgttgaattcacaacgacgactttgtgcaatatgagatgcgagcactgcgccgtcgggtacacgctccagccgaaagacccggatgcgctgccgatcgaccttttattaaagcggcttgatgaaattcctctgttgcgctctatcagcattacgggcggcgaaccgatgctttcgctgaaatcggtaaaggaatacgtcgtcccgcttttgaaatatgcgcatgaacgcggcgtgcgcacacagatcaattcaaacctgacgcttgatatcgggcgctacgaacggattattccttatttggacgttcttcacatttcccacaattggggaacggtcgaggactttgccgacatcggatttgcgatgatggagaagaaaccgacatttgaacagcgggcgcgctattttgataaaatgattgaaaacagccgcacgctggtcgaagcaggcgtaatggtttcagcggaaacgatgctgaacaagcggacgctgccgcatattgaacatattcaccggcagattacggaagaaatgaaatgccagcggcacgaagtccatccgatgtatccgagtgatttcgccagcgcgcttgaatcactcagcctgaaggacatgagacaggccattcatcatctgctcgacattcgcgatgaagagacatggatgctgttcggcacgctcccgttttacgcatgcagccctgatgaagaagaccagaagctcctccgccgcctgcgggaagcgaaaaacgttacggtgcgaaacgaccctgacggccgctcccgcctgaatgtcaacatttttgacggaaatatcattgtcacggatttcggcgatacaccgccgctcggcaatattaaaacagacagccttcccgatgcatatgacaagtggagacagacgaagctgagcaaagagctgaactgccgctgcacaaacgtccggtgcctcggaccgaacgtccttgtcaaaaacagttattatcaggacacggatttttcattacgaaaagccagaggttaacagaagatggaaacgacaattacggatattttgaaaagcaaagtggttgagatcatcatcgtcgctctcgtgctttacgccggtgtttttctgatcaaccgctttgtccaggtgttatttaaacgcatagatttcttggaggaacggaaagggaaaacgattgaaagcctcgtccgatccatcacccagtatacggcgacgatcggttttatcttttacgtcatttcgttattcgttcatgatttcggccgaattttagccggggcgggtgttgccggtatcgtcatcggtttcggcgcccagtcgttaatcaaggacatattggccggtgtctttttgatatacgaacgccagcttcataaaggcgattacgtgacgattaacaatctgttcaacggcacagtcgaagaaatcgggctccgttccctccagatccgtgagtggaccggcaagctgcttaccatttcaaacggtgaggtcagacagcttcaaaactataatattgattttatgcggattaccgagtccgtcgtgatcagttataaagaagatcccgagcgggtatatgccgtcttagaaaaagcctgcgacatgctcaatgatgagcttcgcgattcactgaagcgggatgaatttctcaatgcgacggagccgtttcaagtgcatggaatcatgagcctgaacaaattgacgagaggcatagaatttaccgtcaaaggcatggttcaagataaagaatacttctcggcaagccttgcggtgagacgcgttcttgcccgggagctgtacaacaacaatgtgcaattgcttgaggaaatgtatcacacacaaaaaagctgattcccgaaccggaatcagctttttttatttatctcggctgcgctgtcatttgaaaaccgaatgtgacgtgatcctgcaccggaatccaagccccgattccttgcgaagtcacatttttgacgacaagtttccgcttgctgcctttcagcaccaaatacacttcaccgtatgttacttttcctttttcattaacggccggagcgtaggcgtgcaggtagccgagccgctgcggagaaattttgtaggtttgatcgcgttttgtgcctgcgccgataaccgtttcaaacgcgagcggcagttttgttttcttcatcgctttttgcatcatcatgctttttacgtcttctgcgttcggcaccttcgctgtgagcccgcctttaattttgtactgctgttcttgggcgtatgagataaccgcggtttgctgtccgccccggttatccgctctgttcgtattgatttttttatattcccagttggcgaccgtttcgttcgattgatagccgagcgcccatttcccgagaaatattgtcgcccggtagccgatggcaagcggtgaaccggaaaccgaggattcattcagcatttttatcagatgcggattttcgatgttgatctcggatgtatctaacaattcctttgccagtttgctcggctgaagcatcggctggtcctgtgaagcattcggatacgtattttcctttgaaatgcttacaacagagttgggaaccttaaacggtttctttgcaccggcagacggcattgcgaaaaaactaaaggataacagcagaatcagtgtggcatgaaacagctttctcatcatatcactctttctatagcattttcctttagtcttttcctccgcaatcgttgttatccgcattttttacaggttaaagcaggaaaaaaccgatcgccatgatgacataagcggcaaggagcgtagccccttcaaaccagttcgaatcgccgtcatttgaaatcatcgtcatcaaaaggacggatgatatcatcgccacaagctcgggcaatgtgaatacaagcggcatattgaccggaaaaaagatagaacagatcacaagaaccggggctacaaacatggcgatctgcaaagtcgaacctaccgcgatttcaacggcgacatccatcttgtctttgtacgccataataatcgccgacgcatgctctgcggcatttccgacaattgcgacgataatcaccccgataaacagctcgctccagccgaactgttcagccaccgcatgaaacgtatggacaaggttttcagatatgtaggcgacaataatagttgaaataaataagacggctgtcgctcttttccccgaccactctggctgctcctcttcttcctttgcctccggctgattcggctgataaacaccgcggtgagtgacgagcttgaaataaagagctgccacgtacaaaaggatcatgatgatgctgatgccgacactcaaatcaagcttgtttttttcccccatatctatggaaaacacttcgggaatgacaaaagctacgataatggcaaaaatcagcaggcctgaattatgccgggcatcatgaatattgaattcctgccgcttgtatttcaaaccgccgataaaaaatgacaatcccgcgacgagcaaaagattgccgagcaccgaaccggtcagtgaagcaagcacgatgcccgtcagcccttcttttaaggcgaaaatcgatataatcagctctaccgcattgccgaacgtggcattcagcagaccgccgatccgcggtcccgcgataatggcaagagattcagtcgctctccccatataacttgcaagcgcaataatcgtcaagcaataaataataaacaaaaccgctgacggccagtgcatcaggccgccgatgactgaaagcggcactcccgccgcagccgtaaagaaaaaaatccgattcatatctgcctggctccttttttcgaataagtctttttatatccttctcaaaaactccttcaattacacttcctcggcagcccgaattggcattttcaggttgccggacgcggcaaatccgtgtacgatcaagaaagatactgaagaaggagaaatacgcgatgtcacgactgtacttctttattttggttctgcttgtttccatctccggattttcccaaggcatgcttctgccggtgatctccgtcatttttgaaacgaacggagaatccgcagccataaacggacttcacgcaaccggcctttatatcggcgtgcttctggcgtcgccgtttatggaggccccgctgcgcaagctcggattcaaacctctgatggtcatgggcggatttcttgttatcatcagcttattcagttttatttggcttcaatccatatggttatggttttttcttcggctgcttatcggaatcggggatcatatgctgcatttttcaacccaaacgtgggtgacttccaagtcaacgccccgaaacagaggaagaaacatttcgctgtacggactgtccttcgggcttggattcgctgtcggcccgttcatggtccctcttgtgaaaacaagtccgtcccttccgtttatcgtatccggctgtatcagtctttgtgcctggctgtttgtgtttgccttacgtaacgagtacccggcgcaaggtccggatgaaacatccggggacaacagcgcaaaacggttttaccgcgcccttcttttcggctgggtcgcttttctcccggctttcgggtacggttttttagaaacggcgctgaacggaagctttcccgtgtacgcccttcgtttaggcatatccgtggatgccgtcgcgctgatattgcccgcttttgccatcggaagtattgtattccagttccctctcggtttattaagcgatcgattcgggagaaaacgtgtcctgctcgtcatcttattaacgggtgccctttgctttttgacggccggactgtttccgtcgccttctgtcatcggctgctgctttttcacggcggggatggcggtcggcagtatgttttccctcggcatcagctatatgagcgacctgctgccgtcccatctgctgccggcgggcaacctgctctgcggcatttccttcagcctcggaagcatgatcggcccggtggcgggcggctggtatatgcagcggtttgaaagcgccaacttgttttactttattacggtgattctggtctgtatttggcttgcgctcgtcttcgggaaaacaaagcacagccccgcttccgaatcccattcttttccggccacataaaaaagccgcctgatctgagccaggcggcttctttctagtggtatccgttctgcccgttggcgcttccgcttgttttattcttcgggccgttttttgagttttgtttattatggcttccgccttttttcgtatgcttggtcatagccgattccctccgtttttcagcttgaacgtcatccgttcctctatagcttgctcccgcggtacggattttcatcaggaagctttttacgtttatgtaaaagcgcgttgatttctcctcctaaaatcaacaaggttcccgtaaggtaaaaccagatcatcaggacgataattcccccgatgctcccgtatgtggcgctgtagttggcaaaggtgccgacgtaaaatgagaacagcatactgacgataatccagccggctgccgcgaatacagctcccggcaggacaaaacggagggaaagctttttattcggcgcgaatatgtaaagcgcggtaaacacgattaaaaggataagcggactgataccccagcggacaaccgaccacacctgcaaaaacaggtccgaggcgccgatgaaatccgcggccagcattccgatttctctgccgaacaccggcagaagcagtgcgattaaaatcgtaaccaccatcgcaatggttaaaaaaattgaggtcaggcgaatgatgataaatgagcggttttcctcgacttcgtaggcatggttaaatgctctgacaatcgcgttcataccattcgaagccgaccagatgacggcgataatcccgaatgacaaaagcccgccgctgcgcttgttcagcgtttgctccgttatggatttcaccatggacatggcgctgtcgggcgcgtattgatcgaccgccccgagcacgtcttctgccgatatgggaagataggcggtgagcgtcagcatgaaaatcattaacggaaacaatgacagcaggaaaaaatacgccagctccgccgatttactttgtccttcatgcagagaaaaccttgcaaacagctcctttataaaactcatgacatcccacctcaatgatcgtttttcgaaaaatgctccttcgtttcttttaacaggtcaatgacctgcggtgtcgtctgcttcagcttggtgatctgcccgtttaaaaaactcagatcttccgatacggtattggcgaagattttcacttgatccatttttgcggaagcctgctgcttcagggcttcaggatgttttcggtaaaatgccgcacgccgcctgcacgcgtccatgttccggaaacatgcctctctcgtcggcttatgtaataaggacagtgctccgccggcggcagcgccgatcagaatggcttttgccatgatgcgtgtctgcttcatcggtcaatcccccttataaatgatggtctttctttattgtctccagcaaatgacggcacccggactcgaccaaagcgtacacctcgctgaaatttccggtataatacggatcgggcacgtcggcaaggtctgactccggtacataatcaagcagccttgcaatacgcggcgccgcttttttataaccggccatgctgcgcagatgtccgatattttctgcatccatcgcaatgacgtaatcaaaatcggtcagatcagactcacccgacctgcctcgccgtgatgccgcttgcgctgatccctttctccttcaggatctcctttgtcccttcatgcggcggatttcccgcatgccaggcgccgattcccgctgaatcaatgttaatctgcccgttcagcccgtttttcttcaccatatcagaaaataccgcctctgccataggcgaccggcaaatatttcccagacagacaaacagcacatgtatcatatcgataacctccctattctttccccgcattttgaggatcaaaaaccttatcaacatcttagcaatttttctgcggctgtggaaataagcttttattctaaatgaattctgttagaataaaggggacgaaaacgatcatgaaaggatgcatgaatttgccgagccaacaaacagaaacgttaaataaaatgattgaagacatttcgcaaaagctcaacatgctcaatgtcggcgtcatcagagcggaagatttcagtgatgaaaaaatagaagatcttacataccttcatcaaatggtcatgaaaaaagcatcattcagcccgagtgaaatgcaggccattgccgaggagctcgcctctctcaggaaataaacccatgtcagacctgccgaaaaacggcgggtcttttttgatttaaaaaagtaaaaaataaaagttcatcggtttgacacatataaaaagaaggagtatagtaactgtgaacttggtagaacgatatactaaatgagcgggccgcttatctttttttgtttagtagaacgatatactcattgtgatatcagcgttattcaagtttgtctatgcaaccgttgtatcaaacagttttcaaagaaaggcagtggttcaataaaggggtatggtgctgtgcttttatcaattaaaaaaataatttaattctttattaaccgcattaggggatgtcatcatgaaaaacatatacaccaaaatggcagcgggtctttatattaactatttcctgctgggcatgatcaatattattatcgcatccaatatggaggcattatcaaaacagcttcatacttccgcagccggtgtcagctatttggtctccgccatcgggatcgggaagctgatttcgcttctgtttgccgggaagctttcggatacattcgggagacggccgtttatcgtgtcgggcgcctttctgtatctgattttcctaatcgggattccgctttcgacaaactatacggccgcgtttatcttcgccattttcgccgggatcgccaattcctttttggattccgggacatatccggcgcttattgaaggatttccgaaaaacgcaagctctgcaaccgtgttaatcaaagcgtttgtatcaatcggcgcgacggtgcttccgttttttatcgcgtttattgcggacaggcatttgttttacggctggacgtttttcgtaccgggcattattttcttcctgaacggcttttttctgttgaaagttccgtttccgaatcataagcaaaaagaagacggcggccggacggaagcctctccgtctgatgacgcgttcacatcacagccgtcgatatggcgcgaaggcgttgcgatcattctgttaggcttttcatcaacggcgctgtttatgctcgttcaagtatggcttcctaagttcgggcaatccgttttgggcatgcctgaggtgcaggccgtcaaattgttgagctattacagcatcggggcgcttgtgtccgtgttattgctggctgtgctgttaaacagagtgattcagccgattacggtaatggtgctgtaccctgtgatcgcggcaatcgcgctgcttgctctgattttcattcagcagccggccgtatcggtcatcagctcctttgtcatcggactttcaactgcgggcattctgcaattggcgatgacggttatggctgttttattccctaaaaataaaggtacaatcacatcttttgttaatatagcatcaagcttatcttttattgtcattccgcttgtaacgggagcgatatccaaagccgccggcctgacgcctgtttttctgcttgatatcggaattgcggccgtcagcgccctcctcgcattgtttatcggaatccgctttaagcaagtgatgaaagcctgactattttttaagggagaggatttatcatgcaatctatcacaatcagaaacacggtcatcggtgaagggcttccgaagatcattgtgccgctgatggcggccggagagaaagaactgctcgaagaaattgaagccgtcaacaggcttcgcccggatatcattgagtggcgggcggatgtatacgagcatgttgacagcctggacgccgtaaaaggcatgcttgaaaagctgcggaaagccgcaggagcaacaccgctgcttttcacattcagaacccataaagaaggcggaaataaagttattgatgaccgcttttacattgaattgcttaaaaccgccatcgaaacaaaacatattgaccttgcagacgttgagctgtttacgggagaagcggaagtcaaatcaattgtgaaaaccgctgaagacaacggcgtatatgtcgtcatgtccaatcatgattttcatcagacaccgaaaaaagaagaaatcatttcccggctccggaacatgcaggcgtacggcgcgcacattccgaaaatcgcggtgatgccgcaaagcactgaagatgttttcgtcttattggatgccactcacacgatgaaaacacaatacgcagaccggccgatcatcacgatgtcaatggcgggaacaggcctgatcagccggctggccggcgaagtcttcggctcagcgtgcacgttcggagcgggcaaagaagcatcagcgcccgggcagattcccgttgaggaattgcgcagcgtactcagcattttaaataaacatatgtaatcagcgttttttgccctcaaagcgggaggaaaaacaaatgaatggactaacggaggaatacatcatgaagaaagaattaggacggattaacggaaaaactcagcttatcggattattcgcgacaccgatcggacactctttatctccggcgatgcacaacctggcgtttaaaaaattaggattgaactacgcttacctcgcgtttgaagtcggcaatgaacagctggaagatgtggtaacgggaatgcgcgccttaaacgtcagaggcttcaatgtctcgatgccgaacaagatgaacattctcccttatctcgatgaactcgcggattcagcgaaatttaccggcgcggtaaatacagtcgttaatgaaaacggcagactgatcggacactccactgacggtatgggatacgtccgcaacttaaaagaacacggcatcgatatcacagggaaaaaaatgacgctggtcggttccggcggggccgccactccgatagcgattcaatccgcattggaaggcctcggagaaatctctattttcgcccgcaatgacgcgtttttcgaaaaagcggaagaaaatgtccgcatcatcaatgaagaaatgaagggatcttcttgtaaagcgaaagtcttcccgctcgaagatcaagatgcgctgcgtgctgaaatcgcttcaagcgatattttcacaaacggaacaggtgtcggcatgaaaccgcttgaaggcttgagtgttattgaagatacatccatgctccgtccggatttgattgtgacagacgtcgtttacaaccccgttacgtcgaaattgcttgaacaagctcaagcagccggctgcaagaccattaacggtctcggcatgatgctttggcagggcgccatggcgtttgaatattggacaggccgtgaaatgccggttcagtatattaaagagcaaatgtttgaataacctattgtgacagaagcgccgaaggacaatccgtcttccggcgctttatctttttccccctcctctctctttcttctcatgcgccaaaacgcttataatggatgtaacgaataaaaaccaagtgaggaatgcgacgtatgaaacagcaaaaaaaacgccgggtgacattgcagcaggtcgccgaacatgccggcgtctcaacatccaccgcttcattaattgtccgcaataatccccgaatttccgaagcgacccgtgagaaagtgctgcaatccatgcgggagctggggtacgtatatgatcgggtcgccgcgaatttacgatcacagacgtccacaacggtaggattgattatcactgacatttccaatacgtttttctcagagtttctgatcggcgttcagaatacgcttgaggaagtcggattaacggtgctgttaggcacgacatttgattccgtcgccaagcaggagcagctgatctcgaccatgctggagcacagggtcggcggattgattttgtgtccggtttcagggacggctgaggaaaccctttcccgccttgagcagcttgacattccggtcgtgctcgccgtcagggagattgccgatgccaactgtgattttgtcggagccgattatgaggaaggcacctataaggcagtgcgtcatttcattgagaaaggccatcaggagattgcgtttctgggcggcgtgaagcactcatcaacatggacgaagcgtatgaaagggtttaaaaaagcactccgtgaagcggatctggaagtgaaaaatgaatatgtcattgacagcgcgccgacccgcgaagcaggctgtgacgccgtgacggagctcctccgccggtctgagcgcccgaccgcgattttctgcttcagtgatttggtcgcattcggcgtcatgcaagggatcagaaaagccgggctcgttccgggcgaagatattgacattgtcggctttgataacgtgccggaagctgaaatttcttatcctccgcttacaaccgtttcttcctttccgcggcagtcgggaaaagaagcggctcaattgctgcatcataaaatcaccaattcccagcacaaaaaacaacgcattattctggcgcctgagctggtcatccgggaatcttcacaaaaaaagcggaacgcctgatacggcgctccgcttttatattacgcaagcagttttaatgattcgcggttgaatgccggaatgtcatccggtgtgcggcttgtgaccagctggttctggcagacgacgacttcttcatccaccacattcgcgcccgcgttttccatatcgattcggattgaagtaaatcctgtcgctttgcgcccgtccaatgctttcgcgttgatgagaagctgagggccgtggcagatagcgaacaccggttttttatcatccataaacgctttggcaaattggacgaaacggtcatccgcacgcagcatgtcaggtgagaatccgcccgggatcagcaatgcgtcaaagtctttcggattcacatcatcgatggacgcgtccactttcacttccgcttccccttgttttcctttgactgtttttcctttttcctgttcaattacggttaattcatgacccgcatctttaaaagctttcgcaggttcagtatactcgacatcctcaaagtaatccgttaatacaactgcaatttttttacccatagttactacctcctgcttgatgaagtctacataaatccatgtaccccagccacactaacatcaaacataggtaacgcgtttaccgcccgcctgttttacataggtcattatcctcattttttatcttttcacaagaatcatcatgaaatctatataaactttcacaaaatattcttacaatggtactgcatgacaaaatttgttgaaaggtggagaacaggtgagaatacagaaaagacgatgcagcgtcaatatgacactccgtattctgctgcccctagttatgatacttagtctgatcctcccaacatcacccattaaagcagaagaaaacaaatcctccagtgtgaatctcagcattttagccacaactgacgttcacgctaacatgatggactacgattactacagcgacaaaccgacaacggaattcgggctggcccgaacggctcagcttattgagaagcacaggcgcgaaaacccgaatacggtgcttgtcgataacggagacctgattcaggggaatcccctcggagaatacgccgtaaaatatgagaaaaatgatatcatttcaggcgcaaaaacccatccgatcattgaagtgatgaacagtctgcattatgacgcaggaacactcggcaatcatgaatttaattacgggcttgaattcctggacgggacaatcaaaggcgctgattatccgatcgttaacgccaatgtgaaaacagtaagcggcgaaaaccgttatacgccttatgtcataaaagacaaaaccgtcacggatgaaaacggcggcaagcatcagctaaaagtcggctatatcggctttgttcctccccagatcatgacgtgggataagaaaaatctcgaaggccgcgttcaggtcgaggacattgtggaatccgcaaagaaaaccgttccgaaaatgaaagctgaaggagccgatatcgtcatcgccctcgcccacagcggcatcgaaaaaaaagcgcagtcttccggagcggaaaacgccgtttttgacctggcaacgaaagtcggcggaattgacgcgatcgtatcgggccatcagcacgggcttttccctgatgccgaatacaaaggcgctgctcaattcgacgtcgataaaggcacgattaacggcatccccgttgttatgtcaagcagctggggcaaatatgcgggcgtcatcgacctccggcttgaaaaaacagacagcgcgtggcatgtggaagatgcaaaaggcagcatcgagccgattgccggcaatgtgaattcggaaaacgaaaccgtcgtcaataccgtcaaaaaagcgcacgaaggcactttgaaatacatcagagaacccgtcggccagacaaaagccgatatcaacagtttcttcgcccaagtcaaagatgatccgtccattcaaatcgtaacggatgcgcaaaaatggtacgccgaaaataagatgaaggatacggagtacaaagatctgcctatcctctcggcgggcgccccgtttaaagccggcgggcggaacggctcaaactactatacaaacatttccgctggcgacctcgccatcaaaaacatcggcgatttgtacctgtatgacaacacggttcagatcgtcaagctgaacggaagcgaagtgaaagactggctcgaaatgtccgcggggcaatttaatcagatcgatcaggcaaaaggcggcagccaagcgcttttaaatgacgcctaccgctcatacaattttgatgtcattgacggtgtcacctatcaggtcgatgtcacaaaaccggcgaaatacaacgaaaacggaacagtcattcatcccgatgcaagccggatcgtcaacctttcttatcaaggaaagcccgtcagcgccaagcaggaatttctgatcgtcacaaataattaccgcgcttcaggcggcggaggattccctcacttaagcaatgacaaaatcgtatactcttctgccgatgagaacaggcaggtcttaatggattacatcatccagcagaaaacgattaatccgcaggctgatcataactggtccatccttccggtcaaagggacaaatctgacatttgaatcttccttggccgcaaagccgtttgccgaccgcgcagatgacgtcgcctatatcggtgaatcacaaaacgcgggctacggacagtacaagctccaattcaaagatgatgaaccgggcacagatccgccgaaagatgacgcatggaaactcaccgttatgcatacaaatgacacgcacgcccaccttgataacgcggcgaggcggatgacgaaaatcaaagaaatcagaagcgaaaccgaccgcagcattttgctggatgcgggagacgttttctcaggcgatctctatttcacaaagtggcaggggctggctgatttaaaattgatgaacagcatgggctacgacgcaatgaccttcggaaatcatgagtttgataaaggtccgggtgctctcgccagcttcttgagcggtaacgggagcgcgtctgacccgtccgggaaatacaattttcaagcacctgactttccgctcgtcagctcaaatgtcgatgtgtccaaagagtcaaaactcagaccattcatgaaaaaagcagacacatttacggcagggaaaaagaaaaaagcaggcatctatccatatattctgcttgatgtaaacggagaaaaagtcgccgtattcggcttgacgacagaagatacgtccgtcacatcaagcccgggaaaaagcattgtctttcatgatgccttccaatccgcacaagatacggtaaaagaaatacagaacaaggaacatgtcaataaaattatcgccctgacccatatcggacatcagcgtgatctcgatctcgccaaaaaagtaaaaggcatcgacttaatcgtcggcggacatacgcatacgcttgtagataaaatggaaattgtcaaaaacgaagagccgaccatcgtcgcccaggcaaaagaatacggcgaatatttaggccgtgtcgatgtcgcatttgacaaaaacggcgtcgtcctgccggaacaatcctctcttcaagcgctgccggtgaatgagcagacgaaagaagacccggatctgaaaaaagagcttgatccgtttaaaaaagagctcgtctcagttaaaaatgaaaaagtcggttcaacgaaggtcgcacttgacggccggcgcgagcatgtccgctccaaagaaaccaatctcggaaacttcatcgcggacggcatgctgcaaaaagcgaaggaagcggccggcgcccaaatcgcgatcacaaacgggggcggcatccgcgcgggcattgataaaggagacatcacactcggcgacgtgctgaatgtaatgccgttcggcaacacgctttacgtcgcggatttaaccggaaaacagatcaaacaagccctggaacaaggattaagcggaattgaggctcaaggcggcgccttccctcaagttgccggtttaacatacacgtttacactgaataaaaagccgggacaccgtgttcttcaagcttcggccgtacaggatgacggcagtgtaaagccgatttctgataagaagacatacagagtcgccaccagtaactttgtcggtgaaggcggagacggatattccgtctttaacgaagcatcccataaagaagaccttggctttgccgactatgaggtcttcgttgagcagcttgaaaaagcgggaaaagcggtggaaccgaaagttgacggccgcgcgcaggaagtgtacctgccgacaaaacaaaaaaacggttcgtggacgcttgaagatgacagcgcatttgccgtctatgccaaaaacgccaacacgccgatcgtgtattacgataagaatgacggcgccaaaaagccgattgatctcagcgtgaccaaaaaacaaatcggcctgttaaaggacagaacatcggattcttcccttacgatcctgcatgacaagttcagcatgaaaatgccgatggcaaacgccgcttcagctgatacacgattcggcgtggcgccgaaaggaaaagttagcggggcgctttcaaatgtatacgactttacaatgaagcagaaaaacaaagacatcaaaacattcaaagcgccggtaaagctcaccctgcgcattgagaatatgaaaaaggcgaaacagcccggcatttatcatgtagaccggaaaaagaacgtctatacaaaaacagacaacggttcggtttcacacgatctcgtcacgggctatacaaatcatttcagtgaatacaccatattaaacgcaaacacgaagagcgcgccgccgacaagcggagatcacggctccggaaagcagccaagcggacaaaaaccgtcatccggccctgcgcaggacggagtatcgccgggcggcctgcttcctgatacagccacaacgatgtattccatccttcttgccgggttactcatcagcgcgctcggaacggcactgtatctgtaccaaagaagaaaagcaaaaaaagtgaacgaagcataaaaagaccgcttttatcgggcggttcatcccaagagctctcctgatctgatatcaggagagctttttctgccggtcccctctgagtcgacagccgtacggccgagtgataaaatatgaacgttattcgcgaaagactgcatccgcatcgtttaacacttcacggcggagcctctcttttacacggcgccgcctgtttggaggactttttttgaagattacaggaaacaaacgaaaccgcatgtcttacaagaaaaagctgttttacgtgataacagcgctttgttttatcagctcgatcatttttgtcactcacaacgcttctttttatgagcggccgattgccagagtgacgaaaacaactttggaacaccaggcaaacgtacaggacatgcataaaaacaaagataagattttcaatcagacgatcactgccagacttgaaaacggcagtcagaaagggcagctcattcatttgtccaatcagtattctttatccggagcgaatgatcagaaatattcgattggcgatgaagtattcgtttctattgataaagggaaaccatcaaacaaagatatatcgggaagcattatagataaaaaacgggataaacagcttttgctgatcgcttgggttttcatcttcaccttgcttatcgtcggaaaaaaacaaggcttcttttcgatcgtcagcctgatgtttaacgccgttttactgtcgtttgcattagatttgtacaggaagcatcctaatatagggttaatttttatctgcggtatctgtattctcatctttacggtcatctcattgctgcttgtcagcggttttcacgcgaaaacatatgccgccatagccgcgacgctcgcaggcactttcgtttccctgctgattacgtatctggtgatgctggcaaccggagagaaaggtctcagatatgaggaaatgcagtatttaacccgcccttatcacacggtgtttatggccggggtatttatcggatcactgggagcggtcatggatgtagccattaccatgacgtcatctgtcttcggattatatgaagaaaacaagggtatctcattacaagctctcagacgttccgggatggagatcggaaaagacatcatgggagcgatgaccaatattctgttttttgcttatataagcggctctattccgatgatgcttttgtatttgaaaaatgattccccgataggattcactctttctatgaacatttccttggaaatagccagagcattggccggggggatcggaattgtattaaccatacccgccagtctgtatgcttctgtcttttttattaaacaaaagaaggcaagctcatgaatgtcatcgtaattctcgcggcgattttatttctattaatggtcattatcggcggaaaaaaaggagcgaggtcttttattgcgttattcttaaatttcggggttctctttctcaccattattttcatgacagatccgcatatcaatccgattgttttaacattgctctcttccgccgtgatttgcagcattactcttttttatattaatggaggaaacgtcaaaaccgtaaccgcctttatttctgcgatgctgaccattgcattgctgctgttttttattatgtccgtaacaaaacatacttcgattcagggattcggtgaagaagaattgggggatatcggcatattcacactgtttgtcggggtggattttgtgaaggttaccgcagctatgatcatcatgggcacgattggggcgattactgatgtcgcgatttccattacttcacccatgcgggaaatttacagtcataatccgtccatgagcagaaaagaactgtacacattcggattaagcatcgggagagatattttaggaacgaatacgaatacgttattctttgcttttttcggcagctatttggctttaattatctggtttaaagacttatcatactcagctgaaaaaatagtgaactcaaaagtattcagtgcggaagccgtcaccattctttgcgccggaatcgggatcggcatcatcattcccgttacgtcctggatcaccgcctgttttttagcaaaaccaaataaacattaaaagctgccgggacacgcccggcagctttttttatcttatacccactttacaacgtcttttgaggcagatcttgttttcgggcgcggttctctgacacggtagccgaatgcggccatgacagagatgtcgaaacttccgttttccagaagcccttcttcttcaagaatccggtggatctctttgtagttgaagccttcaacagggcaggaatcgatgccgatctgcgcagcggctgtcatcatattgccgagggcgatgtaagtctgtttggatgcccagtcaaacagcgcgcgatctgattcaagcagattgaaatcatttttctggaagtcttccgttttgctgatatagccttcatacatatcttccggcatttttttgacttcccgcaagtggtttttgacatagtcggcgtcaaaacggatatcctttgccgtccgggcaagcagaagtacgaaatggcttgcggtcggcagctgcttttgcgccccccatgtgaactcgcggagtttttcacgaagctccggattttgaacgacgacaaatttccaaggctccaaaccgagtgagcttggggataatcttcccgtttctaaaatgaattcaaaatcgctttctgaaatttttttctcaggatcaaattcctttgtagcgtgtctgaattgatacgcttcgatgatctgctgttttttatctgacattcatgatctctcctttttatctcgttatgtactattgtagccattatttttgaaagtaccagtacgcacatttttgttggatagtattcattttgatactgacaaaaaaacgggctgccgcggcagtccgtttttatttttctcttctcgcaaagtcgacgaaacggaatttatcgagcctgtgccggctttccgtgtactgaaagaggctggtatcctccaaaaagacgcggtttttcacgaccgccatatggctgaacccgccgagatccaaatacttccggtcttcctcccccgccggctccacgacaatttccttttgcgcgtagctgatggacaggccgagctctccttcgagatactcatagatcgaatcttcacaaatcgccttcgttaatagaggcacatgttttttcacaaagtaatccttgtccaaaataatatgttctccgtcaatccgtcttgatctgacgacttcccacaccttttcatccgccactgtaccaagctcttttgcggcttctgagggaggcaggatcagcccgagacggtgaacctccgttcgcgtctcttttccgagcgtttccgaaagctctttgaagctgatcaggcctgagacgggaaagcgcattttttctctgtctaatatgacggagcctttgcctttgattttctggatgtagccgttttgcgccagcatattgagcgctttacggacggtttctcgtgatgtgccgtattgatcgcataaatcattttcagacggaagaacgtcttcagccttccgctggccgctttcaatctgccgcaccatatctttatagattgtgatatatttattcactttcattcatgaccacccagattagtgtatcacgcttttgtcagatgataaacgatcgattcatacggacggagcgtcaatcgttccggccgcccttccctcggttcatcattcgtcagcagcaccgtaaaccgccagccgtccgtgtctttaagcggaaccgtaaagtccgcttctttcccgtagaagttgttgatgcacagaagtttttcatccttgccgtgtctgacgtacgccagaaccgccggatcatcttcagcaagcagctcaaacgttccttcagtcacgatgtcatattcctttctgagcttgatgagcttctgataatggtagaaaattgaatccgggtcccgcaaagccgcttccgcgttaatgtcccgataatcatccgccgccggaatccaaggcgttcccgtcgtgaagccgccgttcggcccgctgttccattgaacgggggttcttgcattgtctcttgatttctcttttaaaatggcgataatgtctttttctgacacgccttcttccttcatctttttgtaaatgttcagtgattcgacatcgcggtatgagccgatgtcatcgaacttcggattgcccatgccgatctcctcaccttgataaatgtaaggcgtgccctgcatcatatgaatggccgccgccagcattttggctgatttcgtccggtatacgccatcgtctccgtatctggatacggcccgcggctggtcatggttgcaccagaataatgcgttccagcctccgccgttttgcatctccgtctgccaaaacgctaaaatccgtttcagcttcagaaaatcaaacggagcgagcgcccatttttcaccattcggataatccacttttaaatgatgaaagttaaaggtcatatcgagttctttattttcagggtttgtgtaccggatgcagtggtcagccgttgtcgaggacatttcaccgaccgtcatgctgtcatatttcgaaaacacttcccggttcatctcatgaagaaattcgtgcacgcgcggcccgtccgtataataagggcgcccgtcacgaccatcctcggcatcaggaaacgattggtctttagaaatgaggttgatcacatccagccggaagccgtcgatcccttttcggaaccaaaaatgcatcatgtcgtaaacctgttttctcatctcttcattttcccagttcaaatcggcctgcgacacatcgaataaatgcagatagtgctggcctgaggccggatcgagctcccaagcggaaccgccgaattttgattcccagttgttcggcgcccggccgtcttccttgccgtctttccaaatgtaaaaatcccgatacggactgtcgggtgacgaaaccgcttctttgaaccactgatgctcgactgatgtatggtttacgacaagatccatgacgacctttattcctcttttgtgcgcttcatcgagaaggcgttcaaaatcctccatcgttccgtattcttcataaatggtgcagtaatcgcgaatgtcataaccgttgtcattctgcggcgaatcgtaaatcggcgtaagccaaatgacatcaatcaaaagcttctgcaaataatcaagcttctcgataataccgttcagatcaccgatcccgtttcccgtcgtatcattaaagctcttcggataaatttgatataccgctgcctttttccaccatggtgtgctgtctgttttcatttttcttcaccgcctgtattgttttgaatggaaagggaaaagggacagcctgttagaaggcgccccgcaggttttctatttttgccgtttcagccgcgcatacccgtatgttcccgcaaacgggagtatcagcacgatcagcattccgatcgcaaacggaccccagtaccggctcataatggagaagatccccgggacgccgccgactccgaccgagcttgcgagaacgcctttgacggagatgaacatccccgcaatccccgagctgatcatggcgatcacaaacggaaatttgtaacgcagattcacgccgaaaatcgccggctcggtaatgcccaaatatgcggaaatgccggccgtcagtgaaagcccccgctgttttttatcttttgtaatgagcatcatggccagagccgccgatccttgagcgatatttgataatgcgagcatcggccataaaaatgtgccgccgagctttgatccgattaattgaagatcgaccgcgagaaacgtatgatgcatccccgtgatgacaagcgccgaatacagccctccgtacagcaggcctccgatggcggagaattggccgaaaacggcaatcaatcccgccgtcagcgcgttaccgatcgcaaaggtgatcggaccgatgataacaaaggatagaaaaccgatgaccaaaagcgtcaccggcgcgacgaccaacagctgaatgccctccggcgtccgtttcgtcaaaaagagctcaagcctggcaagtaaataagacgccagcagaatcgggagcacctgaccttgatacccgactttctgcacctcaaggccgaacaagttccacaccggaatatcgccgctctgctcggcggccccgtatccccatgcgtttaacagatcaggatgcaccagcatcagcccgagcacgatgcccaaaagcgggcttcctccgaaccgcttcactgccgaccagccgattaaagccggcagaaaagcgaaggccgtccccgcgatcagattaatcatattggcaagatccgcccattgcggatacacttgaacaatcgatttcgtgctgtaaaaaatgccttccgccgttaagatattgttcagacccattaaaagcccggccgtgacgatcgccggcaagatcggaataaagatgtccgcaagcgttttcatagcacgctgtaaaggattcattttttgcgatgccgccttcttcacgtcatccttggacgcttccccgatccccgtttccttcactaattccgcatatactttgttgaccgtcccctgcccgatcacgacttgaaactgcccgtttaccgcaaaagatcctttgacaatgtctattgcatcaagcattttttggtttaccttggtttcatctattaatgcaaaccgcaaacgcgtcacacaatgagtcgccgcctcaatattttcgattccgccgacagcttcagcgatctgccgcgcagcccggttaaactcacccatgccaacccctccgtaaccgttttcattttgtctcaaaaaacttgtatatacatgtttatgactctattgtaatgatgtatatacatgtcgtcaatctatttttatagcgctttcatcacaaatatactgcgaaagaccctgaaacaaaaaaagccccgccggaaccgggccttgacttcttgtttggtcgggaacatgtccgggcggaattcacaacaggagcacaaaaagcatacagtactgtacaactaagttaaagaggtgtgaagagatgccatccactgttatcaacctgtactatttgaagattaacagtatttctggcaacggatctattacgattggggaagcggcatacaacagtcccaccacaaataacaaatcacaaggactgaactcttcattcggcgatacgtcacctatagaatcgatgatggagaacttgttaaatgatcctgatgtcaacgaccagacagccatcggaaccgcagataccgcaaatattacgccggtgccgcccattatagattaaaggggtttttatgaatgccttaccaaattaacgtcgtcaatataaaagtaaacggagcaacgcaaaacggaaacgtcgatatcggtcagaccgtacaaaacagccacaccgccaacagcaaatttgtcggcgcgaacttttctttaggggatttttcgccggccgccggatgtttgaattcgggccatcttgaccctgacgtgagcgatcaggatcagatcgccaacccgtcaatgccgatcgcaaatcaaatatagggaggttctgccgaagtggatatcgaaaaaatgagaaagtggcttgagattacgaacgagcacaagcccagcgacttttggaccaatgtcctgaaacggaaatctcccgaagattttttctccttacaaaaaaacaccctgacttatgatatttatcaggatgaacagcacacatttgtcattgtggaaatgcccggcgtttacgaagaagaattgacattgaggctgctgtcaagaacacggctgcatataagaggaaacatcacacccctttttccgaagaacatgggcgtctgccaaaaccggtattacggggaaatcgatgagacgattgagcttcctgaaccggctgagccccacctgttacaggcgcagtgcgtaaacggcctgctccacatttcctacccgcgccttatggagcacattccttttcagaaaaaaatataaagagccggcttacgggcggcccagccgtctgtacactttctccttataatgagaagatgcgggttttgagaacatggctttctcctccgtcagtttgtcgagtctgacttgtttttccgtccgtttgttccgcaggtgatcccgctcctgttcattgcggcacttggcgatcaaataatcgagcgtcatcagctctttcttcagcgcgccctcatcctcggcgatcccggcgttttttaatatgcggtagcccattctgagcgactccggaagatgtgcggcatcgtctttcggcaggggctttcccattccattgatgccggcgaactctccatccttaatggcgcgcttgattttatcttcagccacgatatgcgcaatatccatcactgtttacctctttcttcaatagaatcgggtgtgatcatacggaaattcacatcccagtttgtgccatttgtgttttttaaagctgtcattcaacagatcaaccgccgctgcgacagcgtttttcgccctttttccgatgagccttttccaccttttctatttgctggtttcatggtatattgattacgttcgttttttctatcgttccgtgtaaaccgtgatcggaaaaaaggagtgtaacaatgaaaacatttataaaagaaagaggacttgccttcttcttgatagcggtcgtgttattgtgggtgaaaacatatgtcgcttatattttaaactttaacctcggcatagacaacacgatccagaaaatattgctttttgtgaatccgctgagctccagcttgttctttcttggatttgggcttcttttcaagaagaaattacagcagacagccattattgtgattcattttttattgtcttttttgctttttgcaaacatcgtctattatagattctttaatgatttcattaccatcccggtcatgatgcaggcaaagacaaacggcggccagctcggagacagcgcgttctcgttaatgagatggacagacgccttctacttcctggataccgtcattttgattattttggcccttaagatgaaaaaaccggctgaaaaaccggcgaagaaatcattcagaatcgttttggcttccgccgtgcttgtgttcctgatcaacctcgccgtcgcggaatccgaccgtcccgagcttttgacacgctcatttgaccgaaactatctggtgaaatacttgggcacgtacaactttacgatttacgatgccgtgcagaatgtgaaatcaaacagccagcgcgcgcttgccgattcaagcgatgtaacggatgtggaaaactatatgaaggccaactatgacgtgccgaataacgtctacttcggaaaagccgaaggaaaaaacgtcatctacgtctcattagagtctctgcagtcctttatcattgattacaaaattaacggcaaggaagtgacgccgtttttaaacaaactggcgcacgataatcaaacattctactttgataactttttccaccaaacgggacaaggtaaaacatctgatgcggaatttatgatggagaactctctgtacccgctttcgcaaggttcggttttcgtcaataaagcgcaaaacacgctgcagtccgttcctgcgatcttaaaaggcaaaaagtacacgtctgccgctttccacggaaatacgcagactttctggaaccgtaacgaaatgtacaaatcggaaggcatcgataagtttttcgattccgcttattatgacatgagcgaagaaaatacgaaaaactacggcatgaaagacaaaccgtatttcaaagaatccatgccgctcttaaagagcctgccgcagccgttctatacgaagttcattacgctgtccaaccacttcccgttcggaatggataaagaagacacggacttcccggcgggagactttggcgattcagtcgtcaataattacttccagtccgcgaactatctggatgaatcaattgaacagttctttaatgacctgaaaaaagacggcctgtacgataagtcgattatcgtgatgtacggagaccactacggcatctccgaaaaccataataaagcgatggcgaaagtgctcggcaaagatgagatcactgaatacgacaatgcccagcttcagcgggtgccgctctttatccacgctcccggcgtgaaaggcggccgcaatcataaatttgccggtgaagtcgatgtcgcgccgaccgttcttcatctgctcggcgtcgatacgaaagattatctcatgtcaggttctgatatcttatcgaaagagcacagagaagtcattccgttccgtaacggagacttcatctcgccgaactatacgaaagtgtccggcaagtattacgatacgaaaaccggaagacttttagatgattcagaagtcgacaaaaaagaagactctctcgtcaagactgagcttgaaatgtctgataagatcatcaacggcgatctgcttcgtttctatcagccgaaaggcttcaagaaagtggatccgtcacaattcgattatacgaagcgtgaagattcctcagcagacgatcaaaaagaataaacaaaagccagatcattgatatgatctggcttttttatgttcagctcccggcggcggccatagtgcgcttttgcaggctgtcggaaagaactgaataagcgattactttctttttctgctgcttgacgacatctacatgatcttcgtagctgtatacaaacaccgtcacatctttttttccttttctcgtcttaatgacaagcggatcggctccgttttgcggatgaagataacgctcttcatcccctgggtatatataatgccgttcgataaacacggcttcgttaaaatcatcaatcacccgtcgtttgtcttcgccttccagacgttttcccccgagggaaacggcagcggactcgtcactgagctttgaatgggtttcaaacttgcggaggatccattccaccgctccggtaggaaggcatgtcagcacaatcttaatcaggcttatgacaacaattgaaacaactgcaatccatgtcaccttacatcatctccatacttgttctacatgaatcttaacatagaaggaaacattgttttttgtacattatgtgaaacttgatatatgttcaaaaaaaatccggatcacataggtgatccggatttttcaagtctgcttctgatcgtcaaggcggacggcctctctcagctcttccgcgacaaattcgacgttcggcccgataatgacctgcgccgttttattccccgttttgataaccccttttgctcccgcttttttaagcgccgcctcattaatgagagacgtatcctgcacggtcagcctgaggcgggtcgcacagtgatcaatcgtttcgagattttgcctgccgccgagccccttgagcatggcatgttcttcgacggaaccggccgtatcttcactaagcacttcttcctcttcctcatcatcttcccgtcccggcgttttcaagtttaacgttttgatgagcatataaaagacggcaaaatagatcaccgcataacaaagcccgacaacgagcagcaaaagcggtttttcggcaatgccgtagctgaggagataatcgatcgcccccgccgagaatgaaaaacctgacctgattccgagaacattcacgataaataaagagaacccggttaatatagcatgaaccccgtacaaaagcggtgataaaaacataaatgcaaattcaatcggctctgtaattccggtaataaatgccgtcagcgcgagaccgatcatcattccggccgtcgctttgcgcttacttggcttagccgcggcaatcattgccagacaagcggccggaagcccgaacatcataatcgggaagaatcccgtcatataagtccccgccgtcggatccttcgcaaagaagcgggccagatctcccgtttttccgtgaaaatcgccaaactggaaccaaaaaatattattcaacacatgatgaagaccgaatggaatcaaaagccgattaaaaatcccgtaaatccccgcgccgatcccgccaagcccgatcatccattccccgaaggacgtaatcaccgactgaatcggcggccacacaaatccgaagatacccgccaaaataatggtaatcagcgccgttacaatcggaacgagcctgcgcccgctgaaaaacccgagatattcgggcagcttcgtatccttaaagcgattatacgtgtatcccgcaattaaccccgcgataatccctccgaaaacggccatattatttgtcgaattgattgattttacagccgcgtccagcatgatataagaaatggctcccgacagagcggcggccccgttgctgtctttcgaaatcccgatcgcgattccgatcgcgaaaatcagcggcagatgatcaaataccgcggtccccgccgcgtaaatgaacggaatatttaataagtcctctctgccgatggccaaaataataccaacggcgggcagaacggcaatcggaagcataaaagactttccgagtttttgcaaaaattgaagcattttacccatcccccttcttttttcttaaatataccacataagttatctagtgatctataccaattttccttcatttattcacataaggcttgttggttttctatttataaaccagttgtggtaagcttgaatcagatgattaaaaatagaaagcgggaatgacaatgattgtaacgaacgatcaagaattagaaggccttaaaaaaatcggcagaatcgtcgcgctggcgcgtgaagaaatgaagaaaaaagccgagcccggcatgagcacgaaagatcttgacctgatcggaaaggcggtgcttgacgagcacggagccgcttccgctccggagaaggaatacgatttcccgggcgtgacatgcatcagcgtaaatgacgaagtcgctcacggcattccgagcgcctctaaaatcttaaaagccggagatcttgtcaatatcgatatttcggcggagttcggcggtttttattccgatacgggcatttcatttgtgctcggagaaggcgatgaacgtctgcaaaagctttgtaactgcgcggcatccgcatttcagaaaggattggatcaggcaaaagccggcaaacgtcaaaaccagatcggcagagccgtctaccatgaagcccgctccaacggatttaccgtcattaaaacgctgacgggccacggaatcggcagaaacctccatgaagcgccgaaccacatcatgaattactacgatccgtttgataacgcgctgtttaaaaacggaaccgtgatcgcgcttgagccgtttatttccacgaaagcggaaacgattgttgaagcgggagacggctggacatataaaacgccggataaaagccttgtcgcccaagtggaacacaccatcgtgattacaaaagacaaaccgattattttaactgcattgtaatgtttcatctccctcccgaacaggtatacaacaactaacccgaaggagggagacgcatgaaaaaagataaagaaaaaatcaaaattgaaaacgaaatacacgccatgcacggcgtaacgaaacagcagattttagaggatttcgaggaatttaaggcgtaccttcatcagaaaatttccgccggaaaaaaactgggtctggatgacagcaaaatcatcaaaagcgccgccatcctcggggactatctcgccaaacacgaggagccccgcaatgcggaagaaaaactcttacaagaactgtgggacatcgcggatgataatgaaaaacagcatttggcccagcttctcgtcaaacttgccggacactgatacagtgcccggcttttttatgctccgttataagagttgtgctacactggacatatgtctgtgaaaggagccatttttcaacatgtggtttattatcttcgggtttattttctttattgaaagcatcattctcaccgtttacggggtgaagaaaaagaaggggatgctgatttatttcggcgtcgttttcggaatcatgacactcggaacggtgctgttaaaattaaccggccattaagcatgaaaagaccgccctttacatatatatgtaagaaagctttacatctctgaatcgaaaggctcagtttttgcattatcccttttcagcgtctttttatagatgttacaatgccaaaagtttggcaaaaactgaagaaacctccccagcgggagaacggagaaaggagttttctgacatgcattatggcagtaaaggctggtatgtagaagagttaaagaaaaaaggaattacccactatgaaggaagaaagcttcaaagcttcaaaaagtacttccttgccaatctgctggaaacaaagaaacaagcataacgtaaatcagccgtgctgtcagtgcagcacggctttttttctatacattagtgagcctgtccctttttttaaggaaggactccctccagctttctgacagcgcttcttcccgcagtatttcttcaatcgctgacagattgtctgaatcacggtatttcacttcgttcgcataccagacggaaatgctttctttgcctctcgacagacgcttgaggacgggacgcggatcgacatatccttcttcaagcaccctgaaataaaagccggtaaatcccgtctgctgtacacggagcaccatatctttgatgccatatttgagcgcgagtttgacgcagggctggcgcggctggcttacttgaacgacggcttcacccagctgaaagatgtcgccgatccacacgtcttgttcggccagtcctttgaccgttacattctctccgaacgcggcggcgggaagttttctcgcgagcgttgtttcccaatatgaataatgctcggcgggatacacgcacaccgctttatcgggacctccgtgatgcttcagatcagcctgcccgtccccgtcaaaatgggttttatacagcatgacgggagaatctgcgggccgcttgatgatgcctgaattgatttgtctgccggcaaattcatgaattgcgggctttccgagattgatagataagacagaatagtcttgcgtcatctcgttcacatcctttgcgaaatatcctacctttcctttatcatagtaagaaaaaggtggtttttccatgcttcagtatcatatgattgcagacggccgggttcagggcgtaggttttcgctacttcgtccagatggaagccgacagacataagatagccggctgggtaaaaaaccgtgatgacggccgggtggaaatccttgccgaaggccctgaagagtcgttaaaacaatttgccgaagcggtcagaaaaggcagccccttctcaaatgtcacaaacgtaaccatcgaagaatcacaccgtctgaaagggtaccgcaccttttccatcagttactgataaggcttgtcctgataaaaataattcggcttcacaatcgtattgtcatatgatttatggaaaatgtgggtggaagccggcgagatcggcggaatcagccaggtccagtcgcccgtcagctttctgcccgcgtcttgttcctgttcttcaaagcgtttaaattgattcgcggccgtatggtgatcgacaatgctgacaccgtgttttttgtatgaatagagcactgccttattcagttccaccagcacctgatctttccacaggtcggtattcaggctggcggaaatccccatgaccgaagcggcttttttgagcatatcataccgcttttcgtcagcaaggttccttgcgccgatttcagttcccatataccatccgttaaaaggcgccgcgttgtacgacagtccgccgatttcaagcctcatatcggcgataatcggaaccccgtaccacctgagatttaaatcggcaaactcttcaatatccggatgggtgatcggcacttctttcacgagcgtctgaggcaggtcataccagaccggctgcccgtcccctttcatccggaaaagcagcggcagaatatcaaattcggtccgcttcccgcgccagccgagtttttcgcagacagccgtcagctcatatgatgccggatcaccgactcttcctttttcagtctcatatcccgcatagcggatgagctggtgattccagatttccacttgtttctccccgttcttctcaggagggaaaatcgtaatcgtcggtttaatttttccgccgttcgtggcgatttcaatatgttcaaataatgcgtcacgcacctcttctttcgtgttcacattgcgccggtcaatgacgttcagcgattgccagaacagacgcccgatacagcggttgctgttgcgccacgccattttcgccccgtgttcaagctcttccgccgtatggacgtaacttcccgtccgatctatctcatcttttatcgcgtgcagtcgcgcgttgatttgcgattccattccgagttcgtgatagcagacatcaataaaatccttcgcctcatcccaaagtatttccgtatgtttcaaaaaactctctccttcaatttacatctgtttcccattgtatcgtttttaggtgtgaacacaatggtttttttgtatcatactggaaactgcgaagaaaaaacacctgtgattttcgcaggtgttttacaaaacggaatgcagtttttcagccagtgtaagcaaatcctcacggtagttttttcccgtcatcggaattccgtgacccgtcaaaagcgcttccggctccagttccgccaatttctgaacggatgcggccgccgtctgcgtatccgctgtaaaataggcgggcggaccgtgaagctcttgcttttgaatgacaacgtccgcaagcgattcctgttcaacagtgatcacggcatcaccggcaagcagcacgcggtctttatcccggaataatgaaatatggccgggtgtgtgaccgggcgtatgcacccatttccattcttcaagaaacggaacggtaccgtctgaaggcagtgcctgaacggacggaatgcggatcgtatggcgcggaaacagcggtgacagctttgcgacaagcccttttttcgcatcgggcctggcaggcggataatccgctttccccgtgacgtacggaagctccttttcatgaatgtaaaccggcacattccaaagctcaagcagttcttcaatcgcaccgacatgatcaaaatgaccgtgtgtcaaaatgaccgccttcagctcatacccctctttgaaccggcgtttcatttcatttgtaatcatctccgacgattgaggcattcccgcgtcaaccagaatgatttcccgcggagctgagggattttcgataaagtaaacattcgcaatctgcacggtcagtccgtaaacgccgtccgccgctttaaaaccggcgccgcttctcactgaaaaaagcggcataaacggatcactcatcatggcacctcctctgatgcctttagtgtgcgacgaaccgggtgttttatgttaaaaaatcgtgattgcgccgatgatgagcgcaaaggccgtcatgacgataacggcaagaaccgcccatttcatcgcaaatttctgatgttcatcaatggtgaccccggcaagcccgactaataaatgcgtcgacggcacgagcgggcttaacatatgaatcggctggccgataatcgaagcgcgggcgatttccaccttatctacaccgtacgccacggcagtctcagataaaatgggcagcacgccgtaaaaataggcgtcattaggcatcagaaacgtaaagataccgctcgttaaggcaacaatcgccggaataaaacctcccatctgttccggaataagcgatacgagggaaatggccatttcatcaaccatcttcgtccccgttaaaattccggtaaacacgcctgcggcaaaaatcatcgaaccgatcgcaagcacattgctcgaatgggctgaaatgcgctccctttgatcattaagtttcggatagttgacaatcagcgcgatacaaaacgcaatgatgaacagcacggttaaattcacttttcctgacactaaaaatcccactaaagaaagcgttaacagtaaattgaaccaccacagtttcggccgcttccattcatcttccgcagccgcagccgtttcatttgtatgggacggctgctttaattcgatcaccccgagccgtttcctttccatccttccgagtacataagcgaccacaatcatacacaccattccgctcgcgatgacaggcagcatcggccccgtcagctctgccggatcaacgccgagcgcactcgccgcacgcggcgccgcgccgccccatggaatcgtgttcatgatacccatgccgaccccggcgattcccgctaaaataatcggacggattccgagcatgatatacaaaggcagcattgcgcttgtcgtaatcatatacgtcgtcgagccgtctccgtccagtgcgacaagcatggtcaaaacggctgttccgactacaattttgagcgggtcgcctttaaccagctttaaaatacgcgacaccatcggatcaaataaaccggtatcaatcataatgccgaaataaagaatcgcaaacataatcatcactgcgatcggcgccacctgttcaataccggagatcatcatctcgccgacccggttaaaagaaaacccggcaatcagcgcaaacacgatcggcgttaatacgagcgccgttaacactgaaagccgttttgtcataatcagcaccataaaaacaagcatcataagaaagcctaagattgctaacacagtatgtcccctcatcatgaatacgcttacattttaaaggcccgatcccctttatccgcctttttgctatcttatgagaattggatattgaagtaaatattttggattttaaagatttttaattttttataaccttttcgttcattttgttcatttataaatcaaaagccttccgcaaatatgcggaaggcttatttttcgctgctcatcatctctttataaaactcggtctgctcttctaaaaagcgttttgcgccgctgctgtttttataaaagctctcccaatcccgttttttcaacatttgcttccactccgcggatgaagtaatctgtttcaaagcctgatcccaataggcgatctcgccttcggtcatgtctttcggccccatgatgcctctccagtgcgcaaagacaaacggcaccccctgctctttccatgtcggcacatcgctgaagccggagagccttttgtcagacgtaacggccgccaatgtgattttccctttccgataggcgtctctcgcttctgaaatggtcattgaggcggcgtctatctcgtgactgataagagcttcaatgacttcattgctgcttccgtattgaaaaaagcggatatcaaacggagaaattccggccatttccgccgctctcgcaaaggagagctggtcatcatttccgaggccgggcgcaaatccgatttttatgccgcccggatttgctttaatatcgccgagcagccgctttccgctttttatctttgaatccttcggaagagcgacggtctgccactcttttgcgataatggccaaaggcgtaaaatcagctgccttcagccggctttgtcccaaaatttcattgcttaacagcagacttgaattcatactgatgacatccgtttttcgttcgtttacatatttccagccgctgtctccgcctcctccgggtttatagatgatctttacgggccggcctaatatttgcttccgctctattaccgattgcaaagcttttgccgttacgtcccagcccccttgaggcgctgccgggacgactatttcaaccggcccttcagctgaacggatgcccgccgcctgccgtccgtcaaaagaaaccagcgccgccagcatgacaagaagcactcccaaccgcttcatttctcccatcccttactcatgtgctaaataatatttccgttccggcctgccgataatgccgtactctaattcagcgagcgcttcttcccgagaaacgagaaactcggcgtagcgccgcgccgttgttctggaggcacccattttttctcccagttcttcagccgtcatccctttttgggccgttctgagcgcgtttttgattttttgaagcgtaatcgaattaatcccggtcggcagatcattgtgctgtttttgttctttctgaccgcttccgaaaaacatgtcaatcacggactggctcagctccggctgtgagtgcagccattctcttttttcacggtactgcaaaagcacttctgtaaatttatgtgccgacaccggttttatgacataatgggcaacgcctgatctgagcgcttcctgcagcagccttgtttcggcagaagccgtaataatgatgatatcaacggaaggaaaacggccgcggataagcgggagcagatctgttcccagctcatccggcatataaatatccaatagcagcagatcaggctgccgtttctcaagcagcgatatggtgtctttggcattgattgctttgccgatgacattgaatccatcaagatgttcgataaatttttcgtgaatttgcgctattcgaaagtcgtcctctgcaatcgcgatgttaatcacaccgattccccctttggcctttctttcggtataaacaccgtaaatacggcaccgccgctcttttgctgcgaaatctcaatcgctccctgcaactcactgacggcttctttcagattggctaagccgtatcctctccttgtcccctttgaagagtagcccttttcaaatatcgtttctgttttttcctgaggcacgccgtctcctgaatccgccacttcgatgacgatatccctgccgatatcggtcataaaaaaggatacctcttttttctctttttcggcgacggcttcgaaagcgttatcaataagatttccgatgatcgtaatgagctgggatgaacccacatgctccggcagcgattctaaaaagctgttttcatctattgaaagcttcactttcttctcagacgcctttcccatttttcctaatagtatggcctgaacccgctgtgaatgaatgttttgaaagaggatttcgtgctgttcattctggatggcgtactcttcttttatcagttcaatggcttcattatattctcccagctctaacagaccgagtatcgcgtaaagcttattcgagaattcatgcgtttgcgcccggagatcctccgagtattttttcatttcagtcagcttgttaatcagtttcttgagctccgttttttcgcggaagctgatcaccgctccgtatacttgtccgttctgcttcatttctttcacgtttaagataaatactttatctccggcacgcacctccacgttcggcggtaattctccccctgccaacaccggcatgagctttgcgcccggcatgatttcttttatatgccttccgatcatcggttccggaagattcagcatatcagccgcagataaattcatcatggttaccgcgccttctttgtttacggcgataatcccttctttcatcgcaaggagcatcgcattgcgttccctgtacagcgctgcaatttcatgcggttcaaggccgagtgtatctttacggatgctttttgcgagcgccgccgctcccccgatgccgataagaaacaccaaacatgcaaaatagcctaaatgccgcaaatgcgccttcatatctttttctatctcatcttgtagaaattcgactgtcaccgttccgacgacttcgttatgatttttttcctccaaaataaccggggcgcttccccggacggccttcattccgtcggaaaccggagacccgccgaacatgacggttttattttgcagattttgattttctttcggaatactgcttcgggccgaatgaaatgcaacatgccctttttgatcagtgatgtagacggcgtgcgcgcctgcctgttctttcatttgttcaatgacgtctaactttgtaaaagcctcttgatccgcaagccggaacgcctcttttacgggaggcatatatgaaatggtttttgccgtttgcaccgccagctgttcagcctgcttctgcccttcctttaattgctgaaaggcaaatataaccgtgagcgttccgatgacaagtattaataaagccgtaattaatccggcgattttcatttgcagagagacataaaaccgcttcgcttccaacacagcaccagccgtcctttcctcctaaaatcataccattttttaaatcttcatttctcatttttgagaattttcgcgatctttttctcttgtcatttctttcaaaaagtgcagtctggtataatttccctcaagagagataagaaggatgaactttttataatcgctgcgcaaaaaaagactgacaggagccagtctcgggatgtttcacaacggacgtatattcagttgacaaagtgtttctctatgatggctgagatacatttgaatgaccggaaatatcaatcaattttcctttgacggccaggcgtccttcggttcttaccgccttgtcgcatgtgattaatgtaatctctttatcttttgtctcctgaattgcgtttgcttctatttctgaaatcatggtttttgatgttacagaataaatatagtcttttctaaagtcggtaatcacgatttgcgcacctttttttatgtgtaaaagagggccgaacaataggttctcctgcttcagatggtggcctgccaacgggtagtttccctcgcccattttctgatccggacgcatagttgccgcgccgatcagcaggttttcattggttgtgccttttaaaatcggaaggtctaaatcgatgctgctgatggttatccgtccgattatcggtttcggtttgcgattaaaacttgactgaactgtttccctgaaaccgggcggatgaatggattcaaattcatagtccgcttttttcatgttatttttccgcgcttgttctgcggtcaattccgattcaatttggcttttactgaggtacgcaatcaaacagcctttcatgagaggagaggaaatgagaagcagcccggacaaaataagaacggcaatgatcatttttttaaccatgaagaaaattcctttcttgtacgtcatgcggtgagtatttggtgagaaatgattctctttttaaaaaagcacctgatcgattcttacatgatcaggtgcgattacgtctatctattccttgctttcttctttcttgatacaacagccgcggctccgccggctaatagcagcagaataccggccgtgaccggcatcataccgtccgtatcaccggttttcggcagatttttgcctgtatccgggtgattggttttactattggtatcagggtgatgcccgccttgattcgtttgatgattcggtgtgtctttcccaggtgcgggattttttaatttcttattagaaacgacgacctcaacagcttttgattgtcctttttcaattgtgaattcaattggtttttcgttcagctgatagccgtcaggcgcttttgtttcgataaatcgatactgcccgggcgctaatcctttcaccgtaaaccggcccttttgatccgtcttccataccgccggccgttctttgctgccgccggtgtttaccggatgtccggcagaatccgttatcttgaattcagcaccttccagcaccttatttttatcgtcatgatccacttttgtcagtgttacatcacccggcgtcagtgtattctccgcactgatttcgactggttttatgtcggtatttgtgatcttgaatgaaattggcgtttgatccaaactgtaaagttcaggcgcttttgtttcgataaattgatattcgcctgctttcagtccccgtacaacaatctgtccgtgctcatctgtcgtcagaccttctctcagcactttgccgtttgcatctgtcagattaaacttcgcaccttgcaggactttccgtttgtcaccttgatccaattttgtaagaacaacactgttcttgatgttaactgcagtcagggcagcctgatccggttttccgctgttctcagccttaatcgtaaaccgcacaggggttgttgacagcagataaccatccggcgcttttgtttcaacaaattgatagtttccgggcgccaaaccgccggcgtcaattttgccgccttcttttgtcatcagatcttctcttacggtttttccatcactgtcaatgattttaaatactgcaccgtctaaaacgtttccgtcttgatccttcttaaccagctggacagagcctttatagttgacaaaggtgccggtctcagacggcttcggctttccttccgctgtttctgagatggtaaactcttttttctccgtatttaacacataaccgtcaggcgctttcgtttcaatgaatgcgtaatgaccgggtgcaaggccggatgtttctacttttccgtctttatctgaaaccagatcgtcctgaaccgtttttccatcacggtcgacgattttgaagactgcaccttcaaggtttcggccttccgcatcttccttcgtcagccggacagagcctttatagttgacggccgttcctgcgtcagttgactccggctttccttccgctgtttctgagatggtaaactccactttcttcgtatttaacacatagccgtcaggcgctttcgtttcgatgaaggcgtaatgacccggggcaaggccggatgtttctacttttccgtccttatctgaaaccagatcgtcctgaactatttttccatcactatcgacgattttgaaaactgcaccttcaaggtttcggccttccgcatcttccttcgtcagcaacacagagcctttatagttgacggccgttcctgcgtcagttgactccggctttccttccgctgtttctgagatggtaaactccactttctccgtatttaacacatagccgtcaggcgctttcgtttcgatgaaggcgtaatgacccggggcaaggccggatgtttctacttttccgtccttatctgaaaccagatcgtcctgaactatttttccatcactatcgacgattttgaaaactgcgccttcaaggttcccgccgtctgcatctttcttcgttaaagcggcttttcctttataattcaccattgatcccaattcaacatcaggtacttgattcttttcgttctttgcgattgagaagtgaatggcttttgtgtttacgataaaccctgatggggctttcgtctccatcagccggtagtatccggcgggcaaaccgttgatctcaactttcccatttttatcgctttcaatattattttttatcagagtataggtaccgtcgcttgattttttctcaagcttaaatacagcaccggccaaaggattattgttttcgtcttttttgataagcgtcaccttatttttttgatttatgactttatagagtgctcctgctgcggaggatttgccgtcaatcgtaacggagaccccgtttacataagcatcgctgatggtgtagccgtccggcgcttttatttctttcagtacataggttccgtaacggatattcccaaacgtaagtttaccggcatcgtctgttgtgcccgtacgcagcagctgcttgccgtctttagaccataattgaaagtctgctcctgaaagagatgttccgtctgatcctgttttagatatcgtcaggcttcccttctcccctgaccctgagccgccgccgcttgaaatagcgacaaacactgagctgttgttctcttgggtctgctcctcaacattcgtccctgatatcgacactttgttgttgacctgaccgctgctgccggaaatattaatgagagaacgatattgtatgacatacgcacggtcgatttgtttatagccgcctgtaaaggtaagggcaaatgattgttcaccggtggcattgtcagttttcatatctaatttatagtccttatctttctcaagctgcacatcacccggaataagatttccgctgctgtctttcataacgccgttctcattatattttgcttgatatactttaaaagaatcttcatctattatttgattctcatccggtgtgtctttgacttttacgtcatccagtgtcgattggctggcattgacattgatgttccaatcgatattgtttccgttctgtttgccgcctttagaaatcaggtttcctccgtttgcgacggaaactgaacccgtcagcgttcggtctgcatggtcattattaaagtactctgctttgtttgtgtattgattctgtttaatgacctggccttttaatgacgttttaaattcaatcaggtatggtacagcgtcatctgttttgagatgtacggttaacgtatttttgttgccgtctgacggctcttctatttcatattttgaaggatccagcgcctctccttcagtgatggagccgtttttgctgatggtatacgttttaacagcaaccgacccatgcaaaaattgctgaccatctgtgatcgtatcttttatataaggatgttttgaaggttcgccattgtaattgatgccgactttccatgtgatttcttttgaaacggcgttgtatgagccgtttttgaatccgttatgggacgtctgattgttcggtgtgaagccgctcgattccttatttgtgcgtttgttgccgtttttatcggtccatgtcgactccgccgtatttttaatcgtttcgtttgaaaagtcagcgttgaattttgtcttatacgtgatcttaaactgactgtttgtttctgcgtagtccccgatcaatgctattgtaaagccttgatttccgggtttttttgttaatgtataatccgttccttctttcagcgttttgttttcagtcgtgtcttgcatgttaaatgaatcgtcaatgagcgccaggcctccgctggtgaattgatcatccagcgtccagtctttcattgtgtaaccgtttttgttaactgtgattgtccaatcaaccgtcttcttctcatagtctgcgtttgaataatgtttgatcagattctgctgaatggcggttcccggagtttcctttgagtcccccgtatctgtcattgctgtattggtgtatttgacaggactgtcaataatgaccccatcgttgacttgagattgataaatgatcttatatgctcctgtgacagtttgcttgaattttatttcaaagccgttcccgttatcagtcagcgtataatcatcaccctcttttaatggggcgccctcttgttcgctgccgttctggctgaatgtaatcggaaggactttcaatgatccgggaactagatgcagatcgtctgatccgaacgtatccttaatgccggctttggattgatcaatctttttctcaccgtagttgtacataacagcccagctgaacgtttgggtttctcctttataacctgtcgaagatttttctatcatttttccgtaacccgctgttacggaagcttccgcagaaatcggctccgcattgtctccgctgaatgccgccttgtttgtcagcgtgatgtttccgcctttacccggctttgcctcatctttaatttccgtgtcatatatgagccggtaggctgaatcaattgtcccggcgaaggtgacattaccgttttcgccaacggtataacctgaagttatctcatttccctgactcaccgagccgtcaatattcacatcaagttcatacactttcacagagcggaaagtcaattcgtccggaaggctttcagtcaatttcgcatttttaacttcttcttcctttttattaaggtcaaccgtccacgttacctttccgggattaatgcctttatccaatgaccctgatttctcaatggttttattgacattcggtttaaaataaaccgttacgtccggcgtatcagagttaaccggaaacttaatcttttgtgtggttgatccttttatttctttctgattgaattgggtgtttacatacaatgaccccttgacgttagaatcttcttttacctcgccgttaaacgtcatgatgacatggccgctcgtattaatggaaaaagttccgtacgtactatcgccgtcggtcaatggctggttcgtaatgtcattatgcataataaattctttaggcaggtcaaattcatatcgatcaccgtcgtttattgttttccccagctcattcggaatcgcccattggatggtgatattcgccggagagttcgtattcgcagggttgtttttgtcatatggttttcctttttcatccgtcaatttcacatcagttaaaatattttgcgtaatccggtttccgcctgattgaaggcttttagcggcagatttgcttgtaatcaccatttttgattgactgcgtttagcagaaggttttgatttcgttgcctgttctgctttatccccgccgtctgcagatgctgattttttctctgtcttatcctgaggttcagcaggtgttgaagaggtgtttttttctgtatcggaatccgttgttccgtctttcttcacaggtattaacacttgctgggtcttgccggcatccagttgaaaaagagcttttgccattttcgtctcatctgttatgtcgggagtaaacttcgccgacagtgtaatggagcctttggcatccccggcatccgcttcagcatcgttcactttcacttccagcgtgcttctgtttgcttcagctttatatataccgatcacccgatcagctgatttcagctcaccttcggcatcattatctaatgtaaaactttccggaatctttacggtgatattccggtcacttgcatcttctttgtgttttagtgaccattcgtatgtcagtgtcactttatctcccggtgttaaagccggttcaccggcttttgatccgtcaacggtctgctgtctgccgtctttgactgcaactgaatcaaagaacccgctctcgctatgttgtgatccggaagcggctgcgatcggagtaaagctgacaacttggctgaagatgaaaaacagcgtgaagcatgaaatcaatgccgccctcagccttttgctttttttcgggctgaacgaaaagttcctcactcccaatgtcttattcctccccttttatatagacttacgttcgaacaagccggtaagcatgggattctccttatccgaaccaaactacattgtatgaaatcggcctatacaaattctgtacatgggatcatttcagaaatagcgcacaaaaaaagaccggcatcagccggtccggtcattcaatcgtcaattgattttatcttttaattgtttatatcgttcgtattcctttatcgcctcttctacctttcccagtttattaaataactgcagtttgtattgtataattttatcgtcaccgggctctattttctcaacctgcaggcaaacgtccatcgcttgacgatcgttcttctcttggatgagaaaaccaatcagttcgtacgctttgctgagccacagatgggcaagacgcgctttttccggctctgcccacagatagccattctccatgagataatggttctcatatgacatgaccatgttcatgtgccgggttagtgcagctgcgctgagcggaggagcctctttgaatgttttttcccattcaactgtatcaatctttaccccggaaagccggagaatgtatcctatatcagtattttctattgattggctgaagggcagcttaccgattaatttccgtatctgatatattgtcgagtagagctgggtgcttgcttttgatatatcataagcaggccaaaacatctccattagcatgtctttactgaccgtgcgcccttgattaagaagtaaaaatgcatacagttcacgggctttggatgttctccacttgactgttatgtatgttttgacaccatttaccgattgataaaagtccaggttcccaaaacattgtataacataatccgtcccggtattcccgtccgccgacctgagttttttattcattcggatccgctcaacagttgtcagcagccgggcattgtcaaccggttttaatagataatcgacagcattcaattcaaacgctttgatcgcgaattcattataagcggtgataaaaataacttggatattttcattgacctcctgaatcgattcagcaagctcaataccgtttatcccgggcatttcaatgtcaagaaacaccgcatcagctgctgaaagttccgaatgctccagaacttccgccggatcttgaaacgttataatagattgaaaggcgtttgtccgctcaagcatacgattaaaatgaagcaatgccagttcctcatcatccacaattaacgctttcaaaccgcatcccacccgtcaatatagatatatctgaaaataatttcaattataccatgcccaatgccctatatagttggattctttttctttctcttgttgtattataacgtttgtgattacaatatttatacattaaataggataatagaatgcccctgaatgggataaaggagtaatgatgtgaaagaaaaatttatttcgattacgattatttgcggctatgctgctttctttatgatttttatggccatggatcatttttcaggatcatccctccctcaagcggaacagggcgtgatcaatctggaaaattgggattttcaaaaggatggaaatgtccagctgaacgggaaatggattctatatccaaatcagatgctgtcaccgcaggcgcttcattcagcaaaaggaaaaaatcccgtactcgttgatgtccctgtcaatgtgaagctgttcggaaaaacggccgacgtggattacggaacgtacaaactgacaatccgatcaaatgaagacaatcaggttttggggatcagcacatcttatatctacagttcaaaccgcctttatcttaatggaaaagtaatcggacagagcggcaatccttcagaaaaagctgattttaaggcgcagaacaaaccgtacagcagctttttcaggcttcgcaagggtgacaatgaacttgtcctgcatttttcgaatttcggaaaagttcccggctgggggatcgcaaaaccgataacgtttgggactcaagaacaaattatacgcgagaatcaaatttccttttttaatgattccattatgattacggcttttttcattaccggtttatattttctcggcttttttctgcaacggacaaaggataaacatttattgttcttttccgtgatgtgtctgcttttttcagccattattcttatgatcgggaaagaaagaattatctttctcctctttccgtctatttcattttcattgctgaattccttgcgtatcatctcaaccgtgcttgtcagcatggcggtttttctttatctcttttatgcatacagagaaattgtttcaaaaacgacgatcaccattttaaccgctttatccgggatcatcttgatcactgattttatgtccggaagtttcattgatcacctctcatacattttacattctgtgctggccgttacgactctgttttatattacatatatttttacgattgccgccataagaaaaataaaaggaagcacgtaccttacactcgcatccgtctcgatgagcgcttttgtgattcttacgaccatttcagcttacagcggcaaaacagctttttcttttaattcgatctattcattgccgacagtcatcgctttattggcggtggttctcctgatggcgcagcaattcgccggagctttccgggacaatgaagtcctctcacggaaattagtcaaaatggaccaactgaaagatgaatttatcgccaaaacttcacacgaattcaagacgccgctgaacagcattattaatatatgccaaacccttgtagccggcagaaaaaagaagacgatagaggaagagaaagaaaatatgcagctgatcatccgtatgggctacagactttccgatctcgtaaatgatattcttgatttggaaaaaatgaagcaggggatgctgcagattcgtccggttcccgtcgatgtgcatgccgtcatatgcagtgagatgaacttctaccggcttttatccaaacataaaaaactcgcgattcttaatcatgtgccggacgatctccctttggtgcttgcagatgaaaaccgattccggcaaatcttaaccaatcttattgaaaatgcaatcaagtacacatccgaggggaacattattctttccgccgcaaacctgaatgacaaaatgattcaaataaccgtgaccgattccggcagcggcattcctgaggctgatcttgaaaccatttttgattcttttcagcaagcgggagggaaggaagaagatggaacgggtttaggtttaagtattgtgaaacagctcgtcaagctccaaaacggggacatctgggcggagtcagcggcggcgcaaggatcagcctttcattttacgttacccgccgctcaaattgtttctttaccggaagcaaagaccgaacttcctaaatcacagcccggacagagaataccggatatttcgttggtcacgccttatcactcagagaaaatcgatgctccgacgattctgattgtcgacgataatatcgagagtttgaaaattttaattgatatgctggaaggtgttccttataacgtaatcgcagtaaaaagcggaaaagaggcgcttcaagctgtctcttcctcgaagcttgacttggtcatattagacttgatgatgcctgacatgacgggttttgaagtctgcacaaacatccgcgaaaggttcagcatggtcgatctgccggttcttatcgttacggcagccattatcagccatgacaaatacaaggcgtttcatgccggagcaaacgacattttacaaaagccttatcattactctgaattcaccgcgcgtattaaaaatttaattttaatgaagcatacggctcaccaagccacaaatttagaaatggcatttcttcagtcgcagattaagcctcattttctttacaatgtattaaatacgattatcgcgctcagccatttggatattgaaaaagcaagggaaaccactgctgcatttacaaactatttaaggatgagttttgattttcaaaacacttcggacatcagctcattcagaaacgaactttctatcattacgtcatatctttctatagaaaaaacacgcttcggcaaacggcttgatatcctttttgatattgaacaggacattgacttcccccttccgcctttaatgatacagccattggtggaaaacgccgttcatcacgggatcagtaagaaaagaggcggcggacggataaagctgacagcgaaaaaacaaggcgaaaacacgtatcttatcaaagtggaggataatggaaccggcatcatgccggacatacagaaagatattttgtcttctgatgttaatcgcagtgtcggcctgaaaaatatcaatcggcggctgaagcatttttgcggaagcgaattgacgatcaccagcaccccggatgagggcaccgctgtttcgatgatgattcacactcccggcacaacggatgattcgaactcactgaaaacgtcttcattaagatactgattaacttcaaaaggcatgtaaatacttctgccgactgtcgggaaattcccgtcagcctttacagaaagacgtaaaaacaaaaaagcttgaagaaaaaatgatatcttctccaagcttagcttagatgatccgcaccagtctggccgttctcacttaagaaatcgtaacccccgcgcttgcatatcccgccactgtattaataagcgaaaggcctgtcgcagtggcagagaataccattaacagccgggtttgaggagttaccgcaatgttcagccctgtcgtgattccgttgctgatgctgccgattgacaatacgccggtgaggggaggagctaaagtgacggatgctccggggatcggcgtgaacgtattgttcggcacagtagaactgtatagttgtgcggttatcgtaacagtcgagccgacaagcgacaatgctgcggttgtactgaaataggcggcaattgatgtaatggttccgcttctcggagcagaaaaagcaaagttcagcagagttcctccagccccggtaagatcaattgcacctccccctccgacattgacgcccgtcacagaattgccgaacccgacaaggctcaccgttccgattaatccgccggcaatggtcgtcacggcagtgggaagacctgaagcgtaaggaatgatcgcgcctgctccggtgatcccggtggcgcctgttgctccagtagcgcctgttactccggttactccggtgatcccggtggcgcctgttgctccagtagccccggttgctccggttgctcccgttactccggtcgatccggttaccccagttactccagtcgctccggtgatcccagttactccagtcgctccggtgatcccagttgcacctgttattcctgtcgctcctgttactccggtagcgcctgttaccccggtagctcccgttattcctgtcgctcctgttactcccgttactcccgttactcctgttactcctgttactcccgttactccggtcgatccggttaccccagttactccagtcgctccggtgatcccagtggctcctgtagcgccagtatccccggttactccggttgcgcctgttactccggtcactccggttaccccagttactccagtagccccggttgcccccgttactccagtcgctccggttgcccccgttactccagtcgctccggttaccccggtggctcccgttactcctgtcgctcctgttatcccagtggctccagttatcccagtggctccagtagccccggtggctcctgttactccggttaccccagttactccggtagctccggtgatcccagtggctcccgttactccaatcgctccggttacgcctgttaccccggtggctcctgttattcctgtcgctcccgttactccggtcgtgcccgttatcccggtagctccagtatccccggttactccagtggctcccgttactccaatcgctccggttacgcctgttaccccggtggctcctgttattcctgtcgctcccgttactcctgtcgctccggttaccccggtagcgcctgttatcccggtggctcccgttactcccgtggcgccgggatctccagtgactccagtggcaccggttaccccagtcgctccggtattcccggtcgagcccgttgctccggtcagtcctgttgctccagtgaaccccgttgctccagtcagccctgttgctccagtgaaccccgttgctccagtcagccctgttgctccagtgaaccccgttgctccagtcagccctgttgctccggtcagtcctgttgctccggtcagtcctgttgctccggtcagtcctgttgctccggtgcaccccgttgctccggtgaatcctcttacgtgaaaatgatttggatgacagcatggacaccatctttcatgacagcaagggggttcgcaacagaatccttcacagcaatgtgcccgattttgataactgcgcctttgatttcttcttttatgttgaaaatgacagcaacactcattacaatttcggcagtcgtaatcccaagaatcgtatctgttataccaagtatctccttttctcattacaccacctctattttcataatatttccacagagaaaaaaggtgtggcaaaaccccacttctattgggcaatttttcaaatgttcgttaagactgcatcatgcacagcattttacagaaaaaagacctaactgtgcataagtcaggtctttcatctttaaaatatcagtctgctgttgtattaggttgtcggaaaacttatgctgttaaaatcgatattgagtgcagttgctgtcgttaaattattagcagttgtgaaaataaccctgagctggtaagtgttcgttcctgcggtcggcgcagtatccactgttgtatcagcaatcgaaaaactatccgtagctgcgagagtactggttcgcgacagagttcttgtatgaatttgcactgctcccctatataatctcacttcaaaaacaaagtttgaattcgctgcagttgttaacgcggcactgagtgcataatccagctttacattctgcaaagcattaactgggattgccagcgtagcaacgggaacttctgtatttaacggcggataaacagtgagcggcccgttggttcttgtgaagagcaaggttggtgtactgcctgtggcgccggttggtccggttgggcccgttactccagttgggccagtcaccccggttactccggttgatcccgttactcctgttactcccgttgctcctgttactccggttgctcccgttactcccgttactccggttgctcctgttactcccgttactccggttgctcctgttactcccgttgctccagttgctccagttgctcctgtcacacccgttgctccagtcacacccgttggaccggttgggcctgttactccggttgcacccgttactcctgttactccagttactcctgttactccagttgctccagtggctcctgttgctccagtcacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagtcacacccgttggaccggttgggcctgttactcccgttgctccagttagtcctgttacacctgttggacccgtttctccggttgaacctgttactcctgttgcgccagtcgctccggttatccccgttgccccagtcactccagtggctcctgttgatcccgttactcctgtggctcctgttggacccgtgattcctgttgggccagtttctccagtggcccctgttactcctgttggacccgtttctccggttgaacctgttactcctgttgcgccagtcgctccggttatccccgttgccccagtcactccagtggctcctgttgatcccgttactcctgtggctccagtcacacccgttgctccagtcacacccgttgaaccggtttctccggttgagccagtaacccctgttgatccagtcacaccggttacaccagttgagcccgttgctccggtttctcctgttggtccagtcacaccggttgggcccgtcgcgcctgttgctccggttatccccgttgctccagtcactcctgttgcaccggtttctcccgttgtcccagttaccccggttggaccggtcgctccagttacccccgttgccccagttgctccggttgggccagttgctccggttgggccagtcgctccggtttctcctgtcgcccctgttactcctgtcgcccctgttactccggttgagcctgttgatccggttacaccagttaccccagtcgatcctgttgctcctgtggctccagtcacacccgttgaaccggtttctcctgttggtccagtcacaccggttgggcccgtcgcgcctgttgctcctgttatccccgttgctccagtcactccagttgcaccggtttctcccgttgtcccagttactccggttgatcccgtggttccggtttctcctgttacacctgttgggcctgttactcccgtcgctcctgtttcaccagttgggccggttgagccagttacaccggttattcctgttgaccctgttacaccggtcgctccggtttctcctattgaaccagttgatccggttgctccagttactcccgttgaaccagttgatccggttggaccggtcgctccagttacccccgttgccccagttgctcctgtcactcccgttgaaccagttgctcctgtcactcccgttgaaccagttgctcctgtcactcccgttgaaccagttgagcctgttgctccggttacaccagttaccccagtcgatcctgttgctccggtttctccagttattcccgttgcgccggtcgccccggatgcacccgttgcgccagttgagccggtttctcccgttgctccagtcacacccgttggaccggttgcgccagtcgatccagttgcaccggtttctcctgttgagccagtcgcgccagttggacccgttactccggttgcgccggttgagccagtcgcgccagttggacccgttactccggttgcgccggttgagccagttgagccagttgagccagttgagccagttgcaccggttgagccagttggtccgatttctccagttacccccgttgcccctgttgcgccggtttctcctgtcgctcctgttactccagttgagcccgtggttccggttgctcctgttgatcctgttaaacctgttggccctgttgcgccggttgggcctgtcgatcctgtggcgcctgtttctccagttaatcccgtcgcaccagttgagccggttactcccgttaccccagtcgctcctgtcgatcccgttacaccagttagacccgttactccggtggggccggttgctcccgttaccccagtcgctcctgtcgatcccgttacaccagttagacccgttactccggtggggccggttgctcccgttaccccagtcgctcctgtcgatcccgttacaccagttagacccgttactccggtggctcctgttgctccagtcactccggttggtcccgttgctcctgttaaaccagttgaacctgttcccccggttgcgcctgtttctccagttattcccgtcgcaccagttgagccggttgagccggctgctcctgtcggtccggttgggcccgttcccccggttacacccgttaccccagtcgctccggttatccccgttgtcccagtcactcctgttggacccgttacacccgttaggcctgttgtacctgttactccagttgacccggttgctcctgttgatcccgttactccggttgcacctgttgctccggttgggccagttgatccggttgctccggtttctccagttattcccgttgcaccggttgagccggtttctcccgttgagccagtcggtccggttattcctgttgacccagttacaccggtcgctccagttactccagttgagcccgtggctccggtttctcctgttgagccagtaacccctgttggtccagtcacaccggttgggctcgtcgcacctgttgctcctgttatccccgttgctccagtcactccagttgcaccggtttctcccgttgtcccagttactccggtttctcctgttacacctgttgggccggttggaccggttggaccggtcgatccggttattccagttgaaccagttactcccgtggctccggttggtcccgtttctcccgttgcaccggttactcctgttgtcccagttaccccagtcgctcctgtcgatcccgttgcaccggttgaacctgttactcctgttgatccggttactcccgtcaccccggttgttcctgttgaaccagtttctccggttgaacccgttgctccgattggaccggtctctccagttacccccgttgcccctgttgggccggttactccagtagctccggtatccccggtcgagccagtttccccggttgctccagttactccagttgcaccggtttctcccgttggacctgttactccggttgagccggttatccccgtcgcaccggtggctcctgttgctccagtcactccggttggtcccgttgctcctgttaaaccagttgaacctgttcccccggttgcgcctgtttctccagttattcccgtcgcaccagttgagccggttgagccggctgctcctgtcggtccggttgggcccgttcccccagttacacccgttgcccctgttgcgccggttgggccgcttggtccggttgggccggtcgatcccgttacccctgttactccggtcgctcctgttactcccgttacaccggttgggccggttgagccagttactcctgttgggccagtttctcccgttgcaccggttgatcctgttactcccgttacacccgtttcaccagttgggcctgttacccccgttgctccggttgggccggttgttcccgttcccccggttataccagttaccccagtcgctcccgttgcaccggtttctccggttgagcctggcgatccagttggaccgatctctcccgtgggtccagttgatcctgctgcaccagtaactccagttgaacctgtcgacccggttggaccggttggaccggttgatcccgttgctcctgttactcccgttgctcctgttgaaccagttgaacctgttcccccggttgcgccggtttctcctgtcggtccggttgggcccgttccccagttacacccgttgcccctgttactccggtcgctcctgttactcccgttacaccggttgggccggttgagccagttactcctgttgggccagtttctcccgttgcaccggttgatcctgttactcctgttgatccggttactcccgtcgccccggtttctccggttgaaccagttgggcctgttacaccagtcgctccggtttctcctgttgcaccagttactccagtagctccagttactccagtagctccagtatccccggtcgagccagttgggccggtttctcctgtcgaccctgttcccccggttggacctgtcgaccctgttcccccggttggacctgtcgaccctgttcccccggttggacctgtcgaccctgttcccccggttggacctgttattccggttgggccggttgggccggttgatcccgttgctcctgttactccagttgagcctgatgagccagtcgcgcctgtttctcctgttactcccgttgcaccggttgcaccggtttctcccgttgagcccgtcggtccggttgaacccgttgcccctgttattccggttgaacctgtagatccagttggaccggtctctccagttgcgccgatttctccagttacacccattgcccctgttgggccggttgggccggttgagcctgtagatcccgttacccctgttactccggtcgctcccgttacacccgttgcccctgttgggccggttactccagtagctcccgttgcaccggtttctccggttgagcctggcgatcccgttggaccgatctctcccgtgggtccagttgatcctgctgcaccagtaactccagttgaacctgtcgaccctgttggcccggttggaccggttgatcccgttgctcctgttgaaccagttgaacctgttcccccggttgcgccggtttctccagttaatcccgtcgcaccagttgagccggttgatcctgtcggtccggttggtcccgttaccccggtcgatccggttatccccgttgtcccagttactcctgttggacccgttacacccgttaggcctgttgtacctgttactccagttgacccggttgctcctgttgatcccgttactccggttgggccggttgctcctgttgagccagtcgcgcctgttgatccggttgaacctgtcactcccgttgaaccagttgagcctgttgatccggttacaccagttaacccagtcgatcctgttgctccggtttctcccgttgtcccagttactccagttgggcccgtttctcccgttgatcctgttactccagttgatcccgttgcgccagtcgatccggttactcccgtcgctccagtttctcctgttgaaccagttacaccagttgcaccggtttctcctgttgaaccagttacaccagttgagccggtttctccggttgagcctgttgcaccagtcactcctgttgggccagtttctccggttgcgccagtaactcctattggaccggttgagccggttggaccggttgagccagtcgcgcctgtttcccccgttggacctgttactccggttgagccggttatccccgtcgccccggttgctcctgtcgatcccgtgaccccgatcgggccagtcacaccagtttctccggttgaacctgttggtcccgttcccccagttacacccgttgcccctgttgggccggttgggccggttgggcctgtcgatcccgttacccctgttactccggtcgctcctgttactcccgttacaccggttgagccagttactcctgttgaaccagtttctcccgttgcaccggttgatcctgttaccccagtcgagcctgtcgatcccgttgcaccggttaatcctgttactcctgttgatccggttactcccgtcgccccggtttctccggtttcaccagttgggccggttgttcccgttatgccagtcgagcctgttgctcctgttactccagttggaccggttgttcctgttgggcctgttgctccagttactcccgttgaaccagttgctccggttggaccggtttctcctgtcgcccctgttactccggttgggccggtttctcctgtcgatccagttggacctgttataccggtcgcgccggttatccccgttgctccggatgggcctgttgctcctgttatccccgttgctccagttgggccggttgttcccgttcccccagttacacccgttaccccagtcgctccggttgaaccggttgaaccagttgctcccgttactccagtcactccggttgagcccgtggttccggtcgctcctgttacaccagtcgagccggttgctccagttactcctgtcggaccagttactccgtttggaccggttacacccgtcgctcctcttgccccggttgcaccagttactcccgtcgctcctcttgcgccggtcactcctgttgggcccgtcactccagtgggacctgtaattcctgttacgccaggttcacccccggtttgcgccaatgaaacatcgtctattaaaaccgtgccggaagaaactttacttaatacaatgacggcagaggccgcgccagaaggcacactgcttgttttatagatttcagaccatgtgtgaaagagcacgttcggcaaatttccgggtgtaatattttcttgaatggaactgatttgttcacctgctgcgctgacatagatgatctggagagtgacttggggacttggatcatttccgagcgttgcgagtgatacgaatagagtcactgacttggctgaaatgggaacgatttgactgaggtaagcatatggctgagctccaataaattgcgcagaatatctccctgaatgtgcaaacaaactgttaatctgggtatttgccgaactccaccccgctaatgtgccggtttcaaagcttccgtttataatcggattattcattcaatctttttccctctccttcccgttgttgaccgtcttacttattaagacagcatattaatacgggctgtgttttgacaacctaaataaaaaaggtgatttcttttcatcaccttaatccgatccttgaatggggaatcccgtcgcaatgagggagcggtttgctgctgcgacttgtgttacgtagttcgaagaaaggacggataaatagagctgatacgcggctgtttcatccgccttcatttcgtcgatgtacgtaaaaggaattcctatgatttgtccgcctgaagaaaagaggttccgctcttgtctctgtgtttgtatcgttacgccatttctttgcagctcgacagctaagaccaatgagaaatgagacgcaagcggatctaattccacatttacttgtatgacggcatccgttttcaccaattgatctgtcggcgcagctatcactgcgcttaacacgtttatcggtgttccttctaacggaagcgtcattaggtctgctgtattttgaaaagctaccgcaggaaccgctcccggcggcccctcaggccccgggggaccgggcggaccgggcggacccggcggacccgcctccccttgcggaccgcgggagccggcgggtcctcttttgccttcgggacctcgcagcccgggtacgcacaaggcagatcgattttcatttgaagacggaaaccgtttttccgtccctgtttccggactttcaagttcacatggtaattgttcataccggcgtttcatatgtctgctcatatatttgtaaggtttctgtttcaatatcatgtattgattacggccgctgctcataatatcaccccggcaatattctattcgcactgaagtcagcgtgtgcaggcccttcccattccttacagaaataaaaaaaaggcagacctgagtctgccttttttcttctaccataaccctaatactttccaccataatccgccgatcacaagccatgtcacaatatggacgattgacaggataaagccgatggaccaccatttgctttgcgagatataacccgctccgaaaaagaccggagccgctcctgagccgtaatgcgtcgtcgaaccgaaaaggttgctgaaaaacgccaggctgagcgccgccaacagcggcggagcgcctgccgccacgatgacggcgagaaatgccgcatacatggcgctgatatgcgcggttgcgctcgcaaagaagtaatgcgtgtaataatacacgacaatcagaatcataaatgccacaatccatgaaaaaccggaaacagatgatttcatcatattgctgaaccaagacaccatgccgagctcattcaggaaattcgccagcatcacaagcgccgcgaaccaagtcagcgtatcccatgcaccttgttcttttttgatgtcctcccatgttaatacctgtgacaaaagcaaaacggataatccgatcagggccgtcgtcgttgcgtcgatatttaagcttcctccgaaaatccacagcgcaagcaccaataaaaagacgataaccatggagagttcggattttttaaacggacccatttctttcaatttttccgttgcgattttagccgcgtccggtgtttctttaatttccggcggatacagcttataaatgacgagcggcgtaatgattaagctcgccaatcccggtacaatggccgcgattgcccagcttgtccatgtgatgtccacccctgcgacatcgtgggccagcttggcgatcagcggattcgccgccattgccgtcaaaaacatcgcagacgtaatcaagtttccttgaaaaccggtttttaataagaaagcgccgattttccgctctgttccgtctgccggcgttgatccgaaagtttcggataatgatctgataataggaaaaataatgccgcccgcccgtgccgtgttgctcggaatggcaggtgataaaattaaatcactgaacagcagtgaataagaaaggccgagtgttttcttcccgaaccgttgtacgaatacgtaagaaatcctggcgccaagcccggttttgataaatccccgggaaataaaaaaggcgatgacaatcagccagattgtcttgtttccaaatccgcttaacgtattttcaatagatagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaaaggaatgatttttactgcctgctgtttttttgcgtctttttctgaagccattacaggtctcctcctattttgttgtcttccatccccctatcccattttactacttaactaagttaataaacgtttttgttaattaaaaaacacaaaggaatattttcctttgtgcttcttgtttattattttaatatacccgacccggctttagatataacatctgattttacatttgatgatgagccgatggaaccgtgcaatgacggtgtccagccgacggactgacttaatccgttggcagctgacgcgttaattgcggcgccgtttaaaagagtgccgtcttcatgaagtgcttttccgccgctgaagacgctgatgactttatcagcagccagtcccggcacttcaaagacattattctgggcatatatttttgacgcgtggcctgcgccccacgcatagctgaacgggtatgcggcgcttttagagcctgcgtaaaaattattataaatatgaacctgcccgtaccggacccgcggtgcgcgctggacgatgttctggtaatagttatggtgaatggtcaccttcagttttccttcatccgacgtcttgctgtcgctgtttccgatgacggagcctttgtcatggtcatgatatttattataggacaatgtaatataattcgccccgttggctatatccgtctggccgtcatggtgctgatattttctcccgtaatagtagggaaaaccgctgtcgggattcgatccgtcattaaaggtgcaatgatcgatccagatatgcgtcgcgccgttaatggtgatattgtcatattccgagttccagttgccgctgctgccgtccgtcgggtcccattgcggaaaatagtcgtaagcgtcttgaaattcaatgttgcggatgatgacattgtcgacgccgttctttatattaaaacttccgcctgtcactttggcatttgaacccgaaccgatgatcgtcgtatttgaaggaatgtcaatcacgacccgtgctttctggtttttttgagatcgctgtctggcgtcttcctgggtgcctgacggcgcttttttcccccatttgtccgggtcgtacgccttcagataagcgttgagatcatatgccggatctttataatcattaaagccgagcgttttattccggtcgtccgtattcatattgattgtgccttgtatgtaaataatcttcggcgtgctgttggcgcttccccctaatgcagaaacgagctgctgtctgtttgatacggtgtagacattcgataaagaggctttcgcgccgccggttgtcccgccggaagcggctccccagccgtcatttgttcctaacgtctgccgtcccaggtcagcggcatagacgtccgcagggatcatacataaacaaaccgccagcataagtaacatttttttcatgaattgtgctcctcctgattctctgttccaatttattacaattggattgtatcaaatcagttgagaaacggcaccgaaaatgtacagcatgtgcctttcggttttattgcggaaaccgcaaaaaaatcccaagggaccgaaaaccccttgggatctgttcagcttacgcccatgattttactttttcgttatccgtgacaaacagaagaacttttccttcatctaagcgcttttcaaattgtgatgcttcctcttctgaaaagccgatttcgtgaattttgttgcggagctcgtcgccttttttattaaacatattgccgaccgcgtgtttaatgcccgtttctttcgctccgatggtattgacatcagtattatccgccagacggtccgttctgtcgtcatcatgtgaaagcacatatacgtcttcttttgcgacacccaattgctgaagctcttttacgtcctgcatcagtttttgatcatttgtatattctcttactaccggtttcattgataagtcctcccttttgtttttgtatattggatgtttacccgctcaaccaaaggtcaaacaaaagaaagagagttccgggaaaaaacgggcagattgtcggtggatattttccggcgggacatgttacagtagggaaagtaacttttatcagaaaaataaaaatcttcatgagccgattaagcagggaggtggttcctattcattacttttcaccggaacagcgatttaacgcttgggttgtcagtgatttagtgaagcaggtattccgccggcatacccgctgcccggatggaataaaagagcttacggcctttgctgaagatacttttcatattaatatcgatttcgttttctctatcattatcaatatcggtgatatcgaatccgttctgccgacagaaattgaaaataagctgggttcttatctgaccgcgcttcagcccgtgattacctctgacatgcttcattcttcaaaaacgaatgcctatgaatatttggaacatgagaaaaacaccgatgtgtaccggttattcttttaaatacgcatataagaaaagaagggccctggcccttctttttttgttgccggcggacggtttgattttgtattcgggaaatggttcgtgttacatttggaacaaccacttatcttgaaggaggattcagtatgccgaataatcagcagcagattcaattggcaagacgcccgaaaggcgttcccgtccatgacgatttccgctttgaaacgattgccgttcccgaaccgaaagacggcgaagtgcttgtgaaaacgagttatgtgtccgttgatccgtacatgcgcggacggatgcaggatacaaaatcatatgtagagccgttcgctttagatgaagccataacaggcggagtgattgccgaagttctgacagacggcgataagctgaaaaaaggagatgttgtgatcggaaatctcgcatggcaggaatattcagccgtcaatgagtccgccctccgcaagttggatacggatatcgcacccgcccaggcgtatctcggcattttagggatgaccggactgaccgcttacttcggcctgcttgatatcgggcgtccgaaaaaaggcgaaaccgtcgtcgtttcaggggctgcaggcgccgtcggctcaacggtcgggcagattgccaaaatcaaaggcgcgcgggttgtcggcatcgccggttctgacgaaaaaatcgcgtatcttaaagaggagcttcaatttgatgaagccattaattacaaaacggcggatgatattcaaaaagcgcttgaacaggcatgccctgacggcgtcgatgtctattttgacaatgtcggcggaccgatttcagatgcggtgataaacctgctgaatgaattcgcccgcattccggtatgcggagcgatctcttcatataataccgaaagtgaagaggaagacatgggcccccgcgtccagccgaagctgatcaaaacaaaagcgctgatgcaggggttcatcgtcagtgattatgctgaccgcttttccgaaggcgcgaaacaattggccgaatggctcaaggacgggaagcttcattatgaagaaacgattacggaaggattcagccatattcctgacgcgttcctcggtttgtttaaaggagaaaacaaaggcaaacagatcatcaaagtcagtgatctaggttaacatgatgatgaaaaaaggagggctttgtcccctccttttctgctttttcgcatcagccgcgaagaatcaaagtaagaaagccgtcttcatcaggctccgtattttccaaagtgaatcccgctgcttgaaagcagactaaactgatttgattgtctttttagatgcttgccgcccattcccgcacgccggtaaacccaggatcagtcagcagtttttgcaagatctgttttccgtacccttgaagctggtacaaaggattgacgatcaatccgatatacgcccgttcctccacaaactctatagagaccattcctgccggaagctgcccgtcatatgccataatgacagtatcgtcttcatctttactcaatcgtgcataccatgcatttagtggccgcatcgcatccattctccgtctgatattatcgttcttaaaccagtgttcaagtattttcagctcacgtaccttcaatatttgaaatcggtctattgaaaccatcttcccgcccccgcctgaaccttttctattatttcacaataaaaaagaagggcttcccgccctccgtttcttatttctcagataattttccgcctgaataaacggcctctttcagctcaattccgagtgatttggccatttttttcaatttggattcttccatcggcgtgacaaggctgagtacggttccttctttaccggcccgccccgtccggccggatctgtggatatatccgtcttcattcgggatgtctgcgtgaatgacgtacggaagatcatcgatatcaagtccgcgcgccgctatgtcagtcgccagaagcagcggaaattctcccccttcaaacgctgataatatctttgcccgctccatttttttcgcttctccgtgcaggatgccgagatccacgtgatgataggcgagtttttccgcatagacgcttaaatttccgatatctctgacaaacacgagcgcctgcatgccgttcagccgtgacagcttttgcaatagcttcactttatcccgctgatcgcagacgagatattgatgcgtgacgcgcgctttttccgccgtattccgcgccactttcaaaacggccggttcatgtgcgatggcattcagcacctcttctgtctccggctgcagcgtagcggaaaagcttaaaagctgtcggtctttcagcgtcgttttaatgatttttttcatcgtttcgcggtgttcctttgtcacgagctgatccgcttcatcaagaacgatcgtcttgacttcatgcattttcagctttttcgcctgaatcaattcgagcaccctgcccggtgtgcctgcaatgatatgcggtttatttttgagcttctccacctgctttttcacgtttgccccgccgatcaaagacaaagcgcgaagatcggagccttttttccactcctgaatcacttgaaaaatctgcatcacaagctcgcgggacggcgctaaaatgatcacttgcggatgtttctgttccgggttgatccgctccagaaccggaagcgtgtacgccaatgtttttcccgttcccgtcggggattcggcaatgacgtctttcccttccatgatcacctgagcggctttttcctgaataacggtcggctcctgaaagcctgacgcctcccagttttcggcgataaatggttgtgtatgctgtaaaaatggccatgtttgggtcatgtcgttctcctcaattcttaaaatctactccatagtatctcaaatgcacgcggcaaacgcaattttctttttccttccaagccttttaacaaacggtctcctcctttataatcataaatgagaaagacacatgataaaaaaagcgtgtctgataacgatagaggtgtaatgatgagtattttatccgtaaaagatttaagccacggcttcggtgaccgtgcgctttttaacaatgtatcgttccgtcttttaaaaggggaacacgtcggcttaatcggagcaaacggcgaaggtaaatcaacgtttatgaatattattaccggaaagcttgagcctgatgagggtaaggttgaatgggcgaaaaacgtgcgtgtcggctatctcgatcagcataccgtgcttgaaaaaggaaaaacgatccgcgacgtgctgaaggatgcgttccattacttatttgcgatggaagaagaaatgaacgagatttacaacaaaatgggcgaagcggaccctgatgagcttgagcagctgcttgaagatgtcggtgtcattcaggacgccctgacaaacaatgatttctacgtgattgacagcaaagttgaagaaatcgcccgcggcctcggcctgcaggaagtcggcctagaccgcgacgtcactgacttaagcggcggacagcggacgaaagtgctgctcgccaaactgcttttggaaaagccggaaattcttctgttggacgaaccgacgaactaccttgatgaacagcatattgaatggctgaaacgctatttgcaggaatatgaaaatgcgttcatcttaatttctcacgacattccgtttttaaacagcgtaatcaatttgatttatcatgtggaaaaccaagagctgacgcgttatgtcggtgattatcatcagtttatggaagtctacgaagtgaaaaaacagcagctcgaagccgcctacaaaaaacagcagcaggaagtggctgagctgaaagatttcgtcgcccgcaacaaagcccgcgtcagcacgagaaatatggcgatgtcccgtcagaaaaagcttgataagatggatatgatcgaactggcggccgaaaaaccgaaaccggaattccatttcaagcctgcgagaacgtcaggcaagctcatttttgaaacgaaggacttagtcatcggttacgatactccgctgtcacgcccgctcaatctcagaatggagcgcggacagaaagtcgccctgtacggcgcaaacggcatcgggaaaacgacgctgttaaaaagcctgctcggtgaaatccagccgctggaaggcacggtggagcgcggcgagcatcaatacacgggctatttcgagcaggaagtgaaagaaaccaataacaatacgtgcatcgaagaagtgtggagcgaatttccttcctttacccaatacgaaatccgcgccgccctcgccaaatgcggcctgacgaccaaacacattgaaagccgcgtctccgttctcagcggaggagaaaaagcgaaggtcagactgtgcaagctgatcaattcagaaacaaacctgctcgtgcttgacgaaccgacaaaccacctggatgtcgatgcgaaagaagagctgaaacgcgcgctgaaagaatacaaaggctccattctgctgatttcccacgaacccgagttctacatggatatcgcgacggaaacatggaattgtgaatcttggacgacgaaagtgctgtaaacacaaaaaggaactcccgcccgtgcggaagttcctttttttaatgtccggcttttattccggcaagatgtttgcgtcccataagaagaacaagcatgccgacaaaaacgacaatcccgcctactgtatatggtgtgcttgcggtgaagtgttctgacagcattcccgcaatccacggagcgagcgcaccgccgataaagcggactgagctgtaggctgaagacgcgatggaacgttcaaccggcgcagcacccatcacagcggttgtcatgatcgtattcaccataccgaggacagcaccggcaacaacgatacatgtaatgatcaacgtctgatggtcagtccagacccccataataacgagaatggccgcaaaggcgataaagagaacgacgagcgaacgcactgtgcccagcgctttatgcacgagcggcgccgtaaagactgacgtaattgccagcagaaggccccagccgaagaagacgtatccgagaccgtgttcatctaaatccagaacgaacggagaataagcaagcaaaataaaaaatccaaagttgtataagaatgcagatactgccattgtcaaaaggcctttatatttgagcgccttcatcgcatcaaacacaccgacgcgtttcgccggtttcggcagcttcggcagcatgagtgaaatcgcgcaaagcgctataaacatcaggacagacactccgaagaacggagcgcgccatgaaaggctgcctagctctccgccggcaagcggcccgacagaaattcccagtccgagcgcggcctcatacagaataatagctttggcgctgccgccgacagatacaccgacgatgacggcaagcgcggttgaaataaagagagcattcccaagtccccagccgccgcgatagccgacaagctgagcgattgaacttgagcttccgccgagagcggcaaacacgatgataaaaataagtccgagaagcagcgtccattttgcgccgatccggcttgaaatcgcgccggagaaaaacatcataaaaccggtaacgagcaaataacttgtaaataacagagatacttcactaggtgaagcatgtaattgtgcggcgattgccggaagaattggatcgacaagaccgattcccataaaggaaatcacacaggcaaacgcaaccgcccaaacggctttcggctggctgaataagcctgttttctgttgtgatgatgtatccatttgaccagacctcctgttttatccattaaaagaaacgctatatccatagcgtttacagcaaaatcattcgattgattgaatggcgcggtcagctttttctttcattccgttaaggcgcgttttaaaatgctgaaatgtgctgatcttctcatcaatcatctcaagctggtggttcaaagcgtgctgaatctcttccagcttttctttccgttccttcggatccagtgacaacaagtacccctctttgtttaattccagctgacggctcatctccataaactgctgaagttcctgaagggaaaaaccgagcacttcttttgtgctggtgactttttcgagctcctccatatcatcttcagagtaaagccggacgccgccttctgtccgtttaggagcaggaatcaaaccaatctcctcgtaaaaacgaatggttcgttttgtcaatccgcttcgcttggcaacttgatcaatcttcatccattccaaggtgaatccccctcttgtcgtatctgtttctattatacaccatttgaaccttaacgtaaacgtaaactttttatgccggataaacttggcttggacggaacctttgtctttaaagcgccgggagacatctgtgtaagataaaaaaagccggtatgacccgccatcttctcggggccgtaccggcttttcttaattctcaagttcttcaatcatcagtgacaattcggtccagcgttccatcgccgcttcaagctcttcagccgtttttgcctgttcggccatcagttcttgtatctttccgaaatcacttcccgcttcagcgatttccgcttccagacgctgatgcttttcttcaaggccggcgattttgtcttcgatgccgtcccattcgatctgatccttgtacgaaagctttttgcgctttttcttcggctcttcttccgcctttttctcttcggccggctgttttaccgccgtcttcttctcttttgcttgttccatgtattcactgtatgaaccttggaaacgggaaatgacaccgtgtccttcaaatacgatcaggcggtccacgacgcggtcaaggaaatagcggtcatgggatacggtgatgacgacgcccgggaactgttcgatataatcctcgagcacgcttaatgtttctgtgtccagatcattggtcggttcatctaaaaacagcacattcggctcctgcatcagtacattcagcaagtacagacggcgtttttccccgcctgacagctttctgatatatgtctgctgcatcggacgcgggaacagaaaacgctcaagcatttgttccgcggtgatgacatcgccttccgccgttttgacgatttcggccgtctcttttatatattcaatgactttcatatcgccgttcatttcgctgtgatcctgggtgtagtagccgatccggaccgtctgcccgatggtgatattgccgctgtcaggctgaattctgccggcgaggctgtttaaaagtgtcgttttcccgattccgttcggcccgatgatgccgattcgttccccagggatgacaagctcattaaactggctgatcagcgcttggccgttataggtaatggagacgttatcggcttcgattacttgttttccgagacggtgggaaccgatcgcgaaatcgagtgatccggagactgccggccctttttgctccttgagcgcctccgctctgtccactctcgctttttgtttcgtcgagcgcgctttcgctcctcttctgagccacgccaattcgcggcgcaggaggttttggcgttttgtttctttctgctctgccagcgcctcccgttcggcccgtttttccaggaatacttcatagtttcctttatacgtataaaggctgcctctctcaagctcgtaaattctgttcgtcaccctgttcagaaaatatctgtcgtgcgtgacaagcataacggcgcccggatattgcgataagtagccttccagccattcaatcgtttcattgtccaagtggtttgtcggttcatccaaaatgagcaggtcagccggctggatgacgtttttcgcaatcgcgacgcgctttctctggccgccggacagctcgctgacatccttcatcagatcggtgacgccaagtttggttaaaaccgttttggctaacgtattcgcctcccacgcatcattcgcgtccattcgggcctgcgcatcaagcaggtgtttctgacgctggtcattttccggttcttcattcagcgcctgaagcgctttttcgtactctctcatcgttctcatgacggctgatccgccggaataaatatgttcaagaacggtttgtccggccggaagctcagggtcctgatgcaagaactcaatatgcacgtttcctgaagccgtaatctcgccttcctccgttgattcaaggccggcaatggttttcagaagcgtagacttccccgttccgttcgggccgattaaaccgattctttcattctcttcaatatgaaaggagatatggtcgaataatgtcttatctccgtatgttttataaaggttttccgcttttatgatgctcatggttcctatcaatcctcacgtaagttcatgtgttcattttaaatcaggcgctgtaataaaactagtaaaaggacagacaaatttcttggaagagatcattttgtccgaagaatgtttccgcctctccttttatacactggaggggaagaggtgatgacatgatcagcgtcagtttgtgcgttatcgtgaaaaatgaagaggaagtgcttgcgggctgtcttgattccgtcaaagacattgcggatgaaattgtgattgctgatacgggctcgaccgaccggacgaaagaaatcgcggcccgttatacggataagatttatgattttgaatggatcgatcactttgccgccgcccgtaattttgtgttttcgaaagcggaaatggattatattctgtggctggacgccgacgatatgctgacggtaaaggaccgtgaaaagctgattgaactgaaggcgtcgctttcaaaagaggtggacgcggtatccatgtattatcacgtcggctttgatgatcggggagaggtcagcttcagataccgccgcaaccgactcgtcaagcgtgaaaaagggttccgctggatcggagccgtgcatgagtatcttgaggtatacggaaacatcatagaaaccgatattgccgtcacacaccggaaatccgaaaaaaagcactcgcctccctcggaccgcaacttgaagatttatgagagaatggcggaaaacagtgaatcgatgacaccgcgcgatttgttttacttcgcgaatgaattaaaggatcacggccagtatcagcgcgccatcacgtattatcaccattttctttccacaaaacagtgctggatcgaagacgagatcagaacgtgccaatatctatccgattgctacagggcggtcggccatgaagaggccgccatgacgtctctcttaaaatcatttctgatcgattgtccgcggccggagttctgctgcaggctcggcgactattttgcggagaaacggcaataccggcagggcgtgttttggtatgagctcgccctatccgccaaaagcagtgatgcaggctttacccagctcgaatattccacctggtacccccatctgcagctctgcgtctgccactggcagctcggcgacagagaaaaagcgaagattcataacgacaaagccgcctcctatcatccgtcacatccgagtgtcctgtataatcaaaacgtgctcggcacataacatcaaaaaaaagagctgccccgtatgaagggcagctcctttttgattacgctgtcggaattcctccgcttacactgtaaatttgggatgtcacatagcttgattcttctgaggccaaaaagacataaattcctgccagctccgccggctgtccggcacgctttaatggaacggccggtgtttccttgccgaatttcggaatgttttctccgggctgtcctcccgaaatctgcagcggtgtccagatcggccccggcgctaccgagttgactctgattcctttattcgccagctgctttcctaggccgacggtaaaaccgataatggcatgtttcgtcgcagcataatccaacagcatcgggcttggattataaccttctacggacgttgtcgtgataatagacgcgccttccggcagatacggaagcgcggctttgacgagccaatacagcgagaatacgttgacttcaaatgtttgatagatttgttctgtagtaagatcgctgatatcatccactgcctgctgtttgccggcgacaagagcgagcgtgtcaagaccgccaagctcttgatacgctttttccgccaattctccgcaaaacgcttcatcgcttaaatctcccggcagcagaacagcttttcttccctctttttcaattaacgctttcacttcttcggcatccggctgttcctcaggcagatagttaatggccacatccgccccttcccgggcataagcaatcgcggcggcccggccgatacctgaatcgccgccggtgacgagggcttttcttcccttcagcttgccggctcctttatagcttgtttcaccgcagtccggcacaggcttcatctctttctgcaaaccgggcggttcttgatattgttttggaaattcatcatgatcatatttcgtcagcgggttgtgcagatttgcatcagacatacaagactctcctttatcattggtgatgtattcgtatgtgtacccctgagcatgacggatcaaacgtgtaagtgcagtttccgattgataagggaaaacaaaaaaggagcccgtaagctcccttttttatgattctccgagcacgttttcagccattttcgctaaatgctgggcgcttcccgaaatctcctgcatcgtggcagaaatttgttctaccgccgccgcttgaccgtccgtgttctggttgatggattcaattgagtcctccagccctttcagcaggctgtgaatttttttcgtaatctggtcaatttggccgacattgtcttttgaatgagtggcaagcttgcggatctcatccgccaccacggaaaagcccttgccggattctcctgctctcgcggcttcaatggccgcattcaaaccgagcagattgctttgatccgagatgcccttgacagtaacggaaatgtcggcgatttctcccgcgctttcactgacttgtttcgcctgagcggaaatcccggtcatctgtgctgagaaaccgctgatggattctgagatatccgcgatcgccgaagcggtctgttccacgacggcggacaggctttcagcgacatcatgaagcttggctgatttttcaaggctcgtgccgagaccgacgccgccgatgacttttccgttttcatcgtgaagcggaatcgctctggcgatcagcggaaatccgaacagctctttcggcaccatgcttgtcttcttctgattcatgcggatcgcgtctgtaatgatgtcccctttttgcagcggatctcccggctttacattaagagaaaacgttttagccggaatattcacgattaatttttctgtatcataaattccgatggtgatgtcatcttggatcaggctgtttaaaaaaggcgcaactttgacaaaagcgtcaagcaggctgtgcgtttgctgctccgtctgtatactcatttctttcactccttcttaatatgggaattggcgtttttcatgctgaaccgaaatccatttcagcgtggtgaattcttcaaggctccattcgccgttcagcctgccgagacctgattgtttctcgccgccgaacgcaacgttcggttcatcattaatggtcgtatcgttgacgtgaatcatgccggtttcgatccgcttagcaaactcaacgccccgctccacgtttgccgtatgcacggctccgcttaaaccgaacggtgtcgcgtttgcgatgcttaccgcttcatcctccgtttcaaacggcatgatgcagacggccggtccgaacagctcctccttcgcgatgctcatctcaggtttcacatcttttaaaatgacaggctcagcgaccgttccgctgaatcggccggacagcaccggaaccgctccctcttctatcgctttttcgacagaccgtctcaggccttccgcctgtctctcattgattaaaggaccgataaccgtatcagggtccatcggatcgccgactttcagcgatgacactttcgcttcgtagagctctgtaaatttgtcataaacagatgtgtgaacgagcacgcggttcgccgacatacagatctggccttgatgcgtaaaccggctgaatacggccgcattgacggcgtattcaagatcagcatcctcaagcacgatcagcgcgctgtttccgccaagctccaacagcggttttttaaagtgtttgaccgcaagctgtccgatatagctgcccactccggttgagcctgtaaatgagattatccgcggcacgggatgctcaacaaagctgtcgccgatctccccgatatccgtcacgatgacattcagcagcccgtccggtacgccggccgcttcaaaaattttcgcgataagcgttccgccgcagatcggcgtttcttcatgaggcttcagcacgacgccgttccccgcgccgagtgccggcgcaacagatttcatcgaaaggaaaaacgggaaattaaacgggctgatcacccctgcgactccggcaggtattctgtacagcctgttttcttttccgtcaatcgtggacgggagaattttcccttccatccgcaccggaaatgttgcggcttcttttatcatatttttgacaagtccgatttcaaactcagccttcagccgtgttccgccaagctcctccatgattaagtaaataatcgcttcttcgtgctcttcaatgaaagaaacggctttttccaaaatggcccgctttttaaaagggtttactttgtcccattcttgtttcgcaagagccgcggcgcgatatgccgcatccacgtcatcaggcgtcgcttttcggaatgaggtgatgactttttgagtataaggatttctgttttccaatacgttccggctgctcccatccctccatcggccgccgataaactgcttatttagttcttcatattgaaacatgtaaacatctccctttcaccgaaacttgaaattagttgatgagtcatcttttgtatcggtcttaaggtgagaaaattgaactatttcacaataaaattccctttccttccgtgcatcgacgctttttagctttgtccttttaaagtggaaaattctttaattgactgcgagaaatttcgacaatataatacaaacgtcagtgtatataatgataagaatattatgaattttcaggaggacccatatgtctttactatttcggaaaaagccgctggccgacttaaaggcccagagcaaacagaccagcctgtcccgctcgttaagcgcttttgacttggttttgctcggaatcggctgtgttgtcggcacggggatttttgtgattaccgggactgtggccgcgacaggcgcaggaccggctttgattctgtcgtttgtgctcgcgggccttgcctgcgcgctcgccgcgttttgttatgcggaattttcttcatccattccgatttcaggcagcgtatatacgtattcatatgttactctcggggagtgtctcgcgtttttaatcggatgggacttaatgcttgaatatgttatcgcgctcgccgccgtcgcaaccggctggtcatcctatttccagtcgcttcttgcaggattcgggctgcatcttccggaggcgctgaccgccgcacccggcagcaaaacgggtgccgtgttcaacctgccggccgttatcattattttggtcattaccgcgattgtttcaaggggcgtgaaagaaagcacccgctttaacaatgtcattgtattgatgaaaattgcgatcattctgctgtttatcgtcgtcggtttcggctacgtgaaaccggaaaactggtcgccgtttatgccgttcggaatgaaaggcgtcatcacgagcgccgcgaccgttttcttcgcgtatctcggatttgatgccgtgtcaaacgcgtcggaagaagtgaaaaacccgcagaaatcaatgcctgtcggaatcatcggcgcgcttgccatctgcaccgttctttacattacggtatcgctcgtcctgacaggaatgctttcgtacaccaagctgaatgtcggagatccggtatctttcgcgctccaatttgtcggccagaacaaaatagcaggcattatttccgtcggcgcgattatcgggattacaacggtcatgctcgctctgctttacgctcaggtgcgcctaacatttgcgatgagcagagacggccttttgccccgcatgttttccaaggttcacccgcgttttaaaacaccgtttcaaaacacatgggtgacggggatcgctgccgccgggatcgcaggttttattgatctgggaaccttggcgcatctcgtcaatatgggaaccttggcggcctttacagtcattgcgatcgccgtcatcgttttaagaaagaaacatccggagatcaaatcttccttccgtgttcctttcgtgccttttgtgccgatcatcagcgcatgcttatgcctgtatctcgcaagcagcctgccgggcgtgacatggctcgcctttgtcatctggatcgccgccgggatcgtggtatatatgatgtattcgagaaaacacagtttgttaaataaataaaaagggaggctcttttttctgtttgagaaagaagagccttttttgcccttgataattcattcaccttatgaataatatggtgtatgcttcgtttacataaaaaggaggagaatcactttggcaattgccgccccgcttaaagaaaaacctgtccatcgtcccgagacaaccatgtattctattttgttcattatcgggatctgtcatctgctgaacgattcactgcaagcggtgattccggcgatgtttccgattttggaacgttccatgaatcttacatttacgcagctcggaattatcgcctttacgctgaatatggtgtcttccgtgatgcagcccgtcatcggctggtatacggataaacgcccgatgccgtatgctttgccgctcggactcaccgcaagcatgctcggcattttaggtctcgcgttcgccccgtcttttctgacgattttatgctgtgtcttttttatcggccttggctccgccgtctttcatcctgaaggatcgcgtgtcgcttacatggccgccggcgaaaagcgcggattggcgcaatcgatttaccaagtcggagggaataccggccaggcgatggcgcccttgattaccgcgctgattctcgttccgctcggtcaattcggctctgtctggtttacgctagtcgccgcaatcgctgtgctgtttctcatttatatcgccaaatggtataaaggccgccttattcatttgcgcgccgcaagtaaaaaatcaccggccgccgctgtgcagaccgtgattacaaaaccgattattcttgcacttatcatgattatcttcttaattttcgcgcgctcctggtatgtgagcgcgatcggcaacttctatacgttctatgcgatgaatgcctatcatgtcagcattcagcaggcacagagctacatcttcgtctttttatttttcggagctgtcggaacgtttctcggcgggccgcttgcagaccgtttcggaaagcggaacgtcatcatcgtttccatgacggcatcggctcccttgacgattttccttccgtttgcgggacctgtcatcgcctatggcgtactggcgctgatcggcgttgttctgatgtccagcttctccgtgacggttgtctacgcgcaggagcttgttcccggcaaaatcggaacgatgtcagggcttacggtcgggctcgccttcggaatgggcgcgatcggagcggttgcgctcggagctcttattgattcagcgggattgacgccgaccatgacagccgtcgcctttctgcccgttttaggtctgctcgcctttgtcctgccgagcgacaaaacattaaaagaatggcattcataaaaaaatccctgccgaaaaggcagggattttatgtttcaaccgtataaaaatgagtgtcaggaaccgcatatttcggaataaacccgtctctgaaatcaggaaacgctttttgaatttcatcaatccatttttttacgtttttgatgtacgggacgtaaatcatactgactgtcgcctcatcatcaatgtgatagtaccagcagagattgaattcgttctccgtgacgagcgtaaagcctgaaaaatgataaaaaatcagcggggtgtcattgacatatacagccccgtcgcgcaggctgacgtcatattgctcaatattccacagcgccgcattcgcgccgatcgactccgtgacatgcacgtgttcaaactgcgcgggccacttttcaacatacctttggtcaccgtatgtctttttttcttcattcatctccaccgtacaataggagatgcaatcctgtctccactgccagaccgcccgatacgcttccccggtattccgcgcgccgacaaacccggtgttgtactgccccgtcagcttgtaataagacgcaaaccgttctgaattgcggtgatccgtcagaaaaagggaagcatccggcttttccgcaaacagctcgcccgcatctgagaagaaaaagagatcggtgtccaaatgggcaaaatattcggcttcatcatactccgtcatcacatggaacagaaaagccggcttcagcgtccagcaatattcatgaaacgtccggccgccctttgcttcaagcagctccgggtcctccatttcatggagctgaaccgctgtgacatgttcccacggcacctgctgaagcagttcgtacgctttctgatcgacacacagcacatacagatgaaaatcccggcaatgctcatggagagaatgaatcatcggcatcagtttaaagatatgcgttctggaaacaatggttgaaaaatgatatttactcaccatatcacatccaatttatttaagatccacatgcagtaaatcagcagtcagcgctttgaacgcccttgcaaagtgcgtgacgcccagctttttttccgcttttgccaaaagctttccgacctccggcagctggaagctgttcgccgtgatccgcgggcttttcgtcttccagtccggatcgaggttgcggtctttaaccgcgtgcagcagttcgagaaaaatgtgcagcaggctttcatatttctcataatcaagcagcacttcgatgtctgccattatgctgttggttaactccgcgtcaaacgggccgttaaacgcgaggtgcacgtcaagcgaatgaatgtcattgtacttgtcgcacatgtacgcgatattcgccctgatgtcatcaacggaagcgcagttgctcggatgctcctgatggacgctcatgatatcgcgccgcagctgaaatctcattcccgactgatgaagcctgatgccgagatcataatcttcaaagccgtatctgacaatgccttcatcaaacaggccgagatctgccacgtgctgcctcttaactgatgaattgttcgtaatgaaaaaacgccatggcagacggtagccgttcaaatcatctccgtatttttccaaaatgcttttcagcacccggataaagtcggtatctaaatcaaagcatcgttcaagaaagcttccgtctctgatgtcactttcatcaaggagcggctctttatcgcccggcagctcttcatacagttcggcgagtttttccttatgctctttttcaaaacggtcataataaaagctgtaaatccgcttccagaacataccgcatacgacaagatcgtcccggttctcatgagccttgatatgcttcgccaccaaatccttttcggcaagcatgtcgctgtcatggaaaatcaaaatatcgcctctggcattgcggaccgcctgattccggccgtaagcgatccctctgttttctttaattctcacaaaaatcagcggaaaattcgcgctgaatgattcaagcatggataaggttccgtcttccgaaccgttgtcagccacaatcacttcgaacggctctgtgcattcctgttcattcagggacagcaggctgttataaagcctctccttggaattatatgcgggaacaatgacgcttgccttcacttttcgttcacttcctgtatatgatcatttatttgttatcatcctcagatgcaaagccgctgaactcggggcagacggcgctgaccgtcccgatcacccgcttcagaatgtcctgataaagctgatggacaaacggcaggtcggtccggtccgtctcatgaatctgccgaatgtcgccggctgtgacgatccggtatccgctgaaatgatagaaaatcagcggatttccgtcttcgagcacaagacgcccgtccttccatgaaaacgtgtggcggccgtaattccaatggccgatattcacgccgggcgtggtgatgtcacacacgttcgggaacagaccggacatgtaatccaagtagccttgatctccgaattttccttcgcccggcgcatttttgcattcttcaaggcagcgttctttccaccatctgagacaatctgtgccggcactgtcggttttgaagctgagaaaaccggaattataccggcctaaaagacgctgcagcatgtcgatttcctgtttttcaaatgagggaatgacgatatcgccccgtgacagaagcaccgaacaatccggctgattgtcaaaaatcgcgcgcggatcagcgaagaaaaacaaatcggcatcaatgtacgtgacacgctctaattccggatgtccgtccagcacgaattcgagaaataccggcttcaccgtccagcagtattcgctctgatccctcgtccgcttcagttcaaggagctcctcattttccagtgcggacacctgaatcaaggtgacattatccggacgcattgcctgaagcacgtcataggtgtcttgatccatacacaaagtaaaaatgggggcgtccgcctgaaccgctttcaatgagccgaacaaagcgatagcctgatacagccttccttttgataaaactgtgcaatatgcgcttgtcacgtctttctctcacctctgtttctgttacttttgaaaaaaggctttataccattcgatcgttttttctaatccttcatcaatggtatgcgcgggcgtccaattcagaagcttcctcgccttttccgctgataaatattggtgcttgatttcgtggcttccctggttaagcactttcggcttgaggtcactgtccatcgccttaagaattttttctacaagttccagcaccgtcagctgaatctcattgctgaagttgaacgcttctcccgcaagattgagctcctccatcttttccgccagcaaaaggtatgcctcgaccgcatcctcgatgtaaaaataatcacggataaatgtgccgtcgctgcggatttccggcgcttcaccgttcagcacgagctgaatcgtctgcggaataatccggttgaagttcaaatctccgccgccgtacaagttgccgcagcgcgtaatacagaccggaagtccgtacgtattaaaatatgtgtggcttaataaatcggcacagctttttgatacgtcatacggatgtttgccctgaagaggcatgttttcatcgtacggcagtgtcggctggtcgccgtacgctttatcactggacgcgacgatcacccgcttgatgagcggatgcctgcggcacgcttcaaggatgttccatgtgccgagaatattggcttcaaatgtggaaatcggattgcggtttgcgacgccgacgattgcctgagcggctaaatgaaagaccgtgtcaatttcatactcgcccagcgcccgctcaatcacatccagatcttcaagcgcgccctgcacgatattcatttgcttcacttgttctccctgatacaggttcgacttgggcacagtgtcacggacaagtcccgtcacattagccccctgatcgatcagttccttcaccaagcagcttcctaaaagacctgtacatcccgtcacaaacacatttttatttttccagaaactcaaacttgatcaccataccttccatacatgttgtccccggtcccacatcttgttaatttccagcagatttttatacgtatcgatcgccgtccagaaaccgtaatgccggtataccgccaattcgccgtcctttgccagctccttcagcggttcttcttcaaacatgacgtccctgtctttcggcagataatcaaataccttcgggctgagcacgaaaaatccgccgttgatgatgccgtcacttgagtttttttcagaaaagcttttcgccataccgtcttcaaccgtcagcgttccgaattgcgaggtcttttctataccggtgacggttgccgcagccccttttgattgatgatagctgatcagatgaaacaggttgatgttcgccagtccgtccccgtacgtcataagaaaggtttcatcaccgatgatgtccttcgcctgtaaaagccgccccgctgtctgcgtgtgttcccccgtgtctaaaaaagtgattttccacggctcggatgttcccaatatccgcacttctccggtagagctgtccagcgtcatgctgtgattcttccagtcataatctaagaaatattccttaatcatctctcctttgaaaccaagaagcaggataaattcgttcacgccatagtattgatagagtttcataatatgccatagaatcggtttgccgcctatcatggcgagcggtttgggacgttcattggtgatttcgctcattctcgttccttttccgccgcagagaatgactgctttcatctctacccctcttctctgtgaatattggattcgaaaccgcccgtataagagaaaccaacccgataatttgtccgattctctaccaccggtttcaaaatctactgtaagatatgagagattggcgccctttgtgaccaaaagctctctcttttttcagattggtgaagatacacacaaaaaaagagcctcacggaaattccgtaaggctctttctattatttattatcctgattcagcttttctttgccgtaatgatatttagacggatcaaccggcgtaaagtcgctcaatttgtggaatctgagcaggtctttgtacatcacgctgtcagacagcttcagctgctctgtgactctggctttcaggtttttcgtttcctgattgcctttcagttctttccctgtcttcgtatcgtatacgacattggagatggaagtatatttcggcgtgacgtaatctccgttgcggaacgtcaccgtatcatcatggtctttcgagaagagatcggtgccgaaattaatatatttcttagaatcgatgccttccaagtgaaggatcgtcggcacaacgtccatttcaccgccgtacgtatggttcaccccgccttttttgccggggatgcgaagcataagcggcacacgctgattctgcgcgttttgataaggcgtaatttctttgccgagaatttctttcatcgcgcggttatggttttcagagattccgtaatggtctccgtaaagcataatcaccgagttgtcatataaaccggatgacttcagatctttaaagaactgttcaagcgcttcgtcaagataacgcgccgtctggaaatagtcatccacagtcgcgtcgcccgttttcgctttttcgatcgttgcgtctttttcatcaagcgtaaacggataatggttcgtcagcgtgagcaaatgcgcgtagaacggctgtttcagcgactgaagcttcggtatagattctttgaagaacggtttatccttcagtcccatattgacaaggttgtcatcagacatatcgtatgtgctggcgtcaaagaatttatcgtagccgatatgtttgtaaatctggtcacggttccagaatgatttgtagtcaccgtgtaaaacggcgcttgtatagccctcactttggtcaaggatggcaggaagcgattgatacgtgttttccccttttgtcacgaaggctgacccttcaggcagtccgaacagactgttatccatcatcagctcggcgtcagatgttttaccttggcccgtttggtggaaaaagttatcaaagtacgtcatgtcctctccgccgcgggcgagtttattcaggaacggcgtaacttctttcccgtcaagtttgtaattgatcaaaaatgattggaagctctccaggtgaatcttaatgatgttcttgcctttggccttgccgaaatactcggcgttcggcttcgcataatgcgacgatgtatagttttcaacgctcgtcaggtcatcactgctggcatatgcccgctgtgattccgtctgcgccgtctgtacgccgtcataaatcgtgtaattataaaggcctaagtattttacaatgtaattgcggtcaaacgttcttgtcagcagctccgggcggtcctcttcggcaatcgccaggttcacgaagaacaacacaatacccgtcacgataattaatgacgtataccgttttttcagcttgaattccttcagctcacgtctccacaccagaagcgcgattaaaataataatatcaacaaagtataaaatatcatggccggacataatgctgaagatgccgtctcccatatttccgacattaccggattgctttaagttcgggaatgtcaagaaatcatcgaagaatcgatagaataggatattggcatacaaaataaacgtcatgatgaaatcaataatcaccatgataatcgctgatttgcggcctttcgcaaacaatgccagtcctaaaaagaaaatggcgcttgagaacggattgatcacaagcagaaactgctgcgtcggacccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccattttaaaaaacgatatatttatcattcgtgtcatgcctattgaacatcttatcccgccagccattagacgcaggatatccgttcttcgtttcacatttttttctggcattaaaaggtaccttatcagacccggtctgaaaataggagataccaaatataagaataacacaaacttctaaaaacgaaaaatgaatatcaaagacagccgcccaacaggcgggctgaagttattgtatgcaaagggactgaaaaacttgaaggttttttttgggtgatgtaaaaaaaggaccggagtcatccagtccttttcatcacatcgctcaaatccccgcccaaacatcttttgcgtaaatgccttttgtctggaggtccaaaagccattcttgcgcttgccgttcgtctgtttcgcggaccgactgatacgctttttgcagcgttgcctctacatcgggcgccattttgctgccgtctccgcatacgtagaggcgccctccccggccgaggatggaaattaaagcgccggcgtctttcgccattaagtgctgcacatacgttttcggtacgccttctttgcgggagaaagccgtatgaagcgtcacgattccgtctttttcataagcttcaagctcgtcacggtaaataaaatcatgatcgtttctgcatccgaaatacagatgagcctcccccagctcttttccttctttttttaacgctgcccgagcctgcagaaatccgcggaacggggcgactcctgtgccgggaccgaccataataatcggtttttccggatcttccggcagccggaatcgtgtttccggagtgcggacaaacatcacgataccatcctcagggcggcggtccgctaaataattcgaagcgactccgcgatactcacccaaaccgctccgggcggggccgcgaacgacgccgacggtaattgaggcctgcccgggatgtttccgaggcgaacttgaaatcgaataataccgcggcttcagcgggcgcaaaagctccagaaatcgctcaaacggaagttcacacgcttcatatttttcaaggagatcgagcatcgagacgcgcgatgttaagatttgctcctgatagacgccctcctcaagaaaatcttccaattcccgtttgtgcggcggacagaccgtataagcggccatttcccggatttgagcccttgatgccgcttcctgcaattcgacacagctgctcagaagatcatgcagcctgaccggccgatcgagcgggagatgagccgcgctctgtccgctggccgtcagcagcacttgatcattcccgttcagattgaaccggcggagaacacggctgacctgctttttgctgtttaccggcagcacgccgagatgatccccttcatgataggcagcctctttcggcagagtgatttcgatatgccttgtgctccggccgctttccggcgcctgaagttccctgttttccgcaacggatgcgtaaaccgcttcatacgtctgtgccaacggagacccgccaagcccgctgacaaattgaaggcccagcgcacttcgctctttttcggcattttcattcagcttaagaccgaatgccttcatggcgtccgtccacatgctttttttccattcatcaagctttccttcaaaatccccgctgacgtccccttcgcctcgggcagaaaagcgttccgccctttttcggcaagcttctcatcaatcagtctcggcacagcctgatatgtcgccgcccagttatgatcaccgcagccgaagacggcatatcggacaccttccagctccccgggtttgacttcttcaagccattgaacgaattgtcccgcgttgctcggaggctttccgttataagaggacgtaatgatcaagagagctccttctttcggcagttttccgatccggtcatttaaaggcgccgtttcagtccggacgccgtgcatcccggcagtatcggcaagttcccgcgccacgccttctgcggttcccgtatctgagccgtacaaaatcagaagcggtcggttatcaagcccgataatggatgcgccttttgtttcccgtttttctttttcgacgtcttccgccgctttttcagccgccgggagagctgccgcaacggctcctttgtttctcggccgcacccggatatgaaagtcgccgggcttaatcgtcagtgtctgtttaatatcgagctcataatcggtgtgatcgataaaggtaaaatgctgcagaatcatccccagaacaagagttgcttcatgcagggcgaactgcataccgatacacgccctctgcccgtttccgaaaggcttatacgcatggtgaggcactagatcaggatgttcaaaccgctccggataaaattcctccgcattgtctccccacgcgtctttatcacggtgaagctggggaattaagacggaaattctgtctttcggcgtgatcggatatttcccgccgatcaccgtatcctctttcgcataaaggctgaacgcaggcgcggtcggccataagcgcaatgactcctgcaaaatcattcggatataactaagctccagtacttgtttataagaaggaacgggatcggtcaaaacccgatcggcttcttcataggctttttccaaaacacggggatgtttcagcagaaaatagatggcaaaggaaagcaggccgctggtcgtttcgtggccggcaattaaaaacgtgatgatttgaaaccggatattttcatcatcaagtttttcgcccgtttccgggtcttccacattcagcattctggccagcagatccttttcatcccgtccgcctgaccggcgctctgcgataatactgtctactaacgaaaacatcgcctgaatgtcatgatgaaattggcgcttcgtcctgatcatgagcttatcctgaacatcaaggcgctgcatttggtgcatcgcttcatcaagggcgcgcaccatgctgttgataaacggatgaggcgtttccctgtaatagctgttaaaccgatagttaaagccgcaaagcccgatcgtatcgagcgtcaggcgggtcatatcagcaggcacatcaacggcctcatccgggttcagcctagcccatttttgaatcagctgcaccgcgatatcagtcatcatcgaatgataatctttcatcgcgcgctggctgaaggtcggcatcagaatattatgcgcctttcgccagttaggctcatgcgtccagcttgtaaacagcccgtcaccggcaaacgcccggactttctccaaagcaccttcaatgcttttatcgaaccgctcttcatcacatacctctttcaccagttcatgtccggacacgacgataatggcgcccgccggggtatgcagctgaaaaataggcccctgctcgtttgccagtttgatcagcgacattgtaggcttgtctttatcaagcaaaggaagattgccgagaggaccgaatgtcttcggctgcggaatcggacctgtttccttcatgaataacaccctttcttacacattgatgcgttccttccaactacagtgcccttttcaccggccaattatccgccgttacggatcaatccccggattgacgattgataacggttttttctatactggagaggcttgttaaatacagaaataaggtgagttcacatatggattttgaaatcaagtttttatcgttttatgtcattcaagtggaaggaaaagacgaacaggcaaacaaacagttcaaacatttccagacccttgacacagacgaatttgaagaaagcgagctgaaggattttcttgacggggaattgaagaaaatcgtcaaacggaaagctgaacggcatccgcaatccgagcaggtccccacaaaaatcggccattttatcacggagccgggccatgagcttgattcaaatccgaattacaaccttttcaaccgcgccagacttgcggatacgaaggaagcatttatcgaggcaagcgaacagttcgtccgtacttatcttgacacgagcgccgtgcgcggcggtgtttttatcgtggcttcggccgttccgcgcaaatattttgaggacaaattcgtctttatgatgaaatgcgatttcgagccgaaggtcgcccgcatctcagacgcctcgtctctcattaaaaaggtcgaaatggccatcacgacaaaaaacatgaaaagcattcaatatccgtatatgccggaagaaggcatgacggaagagcatgagctgaaaatccaccaggcctcgcacgcccgttatttcgaagattttctcaaatttgtcgaatatggcgaatcgatgccggaaatcatgaaaaaccaagtcatgaacatggtgcaggagcacgtgtatgaaacttttgaagaaaacagcgaagagcttcagcagtttgagcacgacattgaaatttgggaagcgagtgaaaagcgggaaattcaggagcgcctcgacacccatcaagtcatcgaggcatccgcgcagatcattgaacacacgccggaagccgagctgaaaatgaaagtcggagaaacagagattaaaggattactggctgatttcggcgaatccatccatctcgcaaaagtgaacgggcgctatgtcgcgctcattgaggcggagacgatctcgtttgaaaaaggcagttcgccggtggagtttcacaagcctgaggggctgcatgaggtgattgagcggatacggaataaatctgaacaagactgacaaaagtccagacgccatgttctggactttctgtatttaataaggctctttgagcaatcgatagcattcaccgatgatgtcttggacgccgggcgttccctttatctcgcggcggacgatttcagatgagagattctgcacctgtaatgcccgctccgcccgtctttcgaagtatgcttgacatgcagtttcatggttttcgtgtttttgcagttcttcactaagcacaatcgcgtcttcaatcgccatcgccgctccctgcgccaatgtcggcgctcctgcatggacggcatccccgcccagaacgacgcggcctctgtgccacggttctttgaccgccatctgctcaatcttatgaaacaaaacgggatattcctttgacatattctctgtcacaaacttcactcccggaattccgcgcagcaagtctctcacccgttcaaaacgcgtgtcctcgtcatccctgaagtcagcgtcatacggccggatgataaatacgtatcctgttttttcagagagcggcacgaccccgacctgcgtctgcccctttttatacatcagtgtcgaatcatgaaaaaccggctcgggaaaagaaatgtaaaatctgtgcgctcccatgccgagatactctgttttcacttccctttgcagcatgtgattgcggacagcggagcggatgccgtcaaagccggcgaggatgtcagccgtcatcgcggttccgtctccacaatgcaccgttatttcatctgccgtttcttcgtaagacacgacttttttaccgggcagaatcgtgacccccgccgcctcagcatgcttgctgaggatatcgtttaatgtttgccgcaatatattattccgccccggcaatgaatcatctaaaaacgcctcactcactttaaactgcagcgttccgttttcatcatgctgcttcagccaatccgtttgaaagccgtgttgacagcattcatcatacacaccgatttcccgaagcacccgaagcgcattttgaggctgaagaatgcccgctccgctttttcgcatgtcggacgccgcctcgcaaagggttacttcaaaacccgctctgccgagagaaatcgctgcggacaggccgccgatccctccgcccgctatgatgatctttttcacttcatggttcatcacgataccgccttctcaatttatttatcatttgttaactattagccaccttactatattggctgaaaaactgtcaatctttataggttgccttttgaatccggcaagcttatactttgaatcactaaaatggtacggaggcttacaaaatggaattgagacatttgccggattactcgcagattgccggacgcgctgagatttacgccgatatggatgctgaatcattgaaaacatttttgacgttatttgatatgtctaaaaaaatgaatcaggtcatggagcattatttctcaagtcacggattgtccgaagggaaattcaaaattttaatgtttctgtttgacgaacccggccacagcctgagtccgacggagctggcgaaaaaatccaatgtcaccaaagcgaccatcaccggattgatcgacggactcgcacgggacggctttgtaaaccgcagccggcataccggtgacagacgaaaaatcagcatcgaacttacaagggaaggaaaagaaaagctgatgctgtttcttcccggccacttctccaacatttcaggagtcatggaaagcttcaccgctggagaaaaagcggaattgacaaaaatgcttgaagttttatttgataagcttctgctgttttccggagacagaacataaagtagtattgtaaaaacaaaggcaaatttctatgagatagaaattgaagtaaaaagatgagggttataaaaaaacagcctgcacattagtttgttcaggctgtttcagaagaaataattttaaaattactttctcttcactataaatgcaggtgttttaatgctggaagttacatttgtatatcgatttttagtcttcaacctcactctcacactatttgatcctttttttaacgatttttgatttgagagtttaaatacttttttaggtgttgagtgactgaaagaacctttctttgtttcattagccacccattttgaaccgttccaaacatcaattgtcatggaataatcaaatgttgcgattgtcccgccccatatgatgctacacaatcaatagaagtagcttttgcagaataagaatccgcatcggtacaaactctcaatacatatgttgcataatctgtactacaaggcataatatccttcccctttcaaattttttgaaacaggtttgttattatgacaaaccctccgttcacttctagctggcaaacgtatgacaaagggaatctcatggcttatgagattaaaaattcaaaactcttaaaattaacaaaaggcgcccctcttagcagggcgcctttttcgcgcgattaatcatcactgtttaaaatcccgaaaaaccgaagcaggttgataaacaagttgataaagtcgatataaagcgtcaatgccatcaaaggaatcaggtcagccgtgatgtcccggtgcttgatctggttcagatcgtataagatgtacattgaaaacacaattgttccgatgacggaatacgccatcatggcggcggaattcagcgggctgaaaatattaaatatccccactgcgagaagcgcgataagagcgacaagcaagaaggaccataaaaacgacaagtcctttttcgttttagcgccgatcgtaccgagcaccgcaaaaatgacaaacgaagaaccgaatgcctccaatacgacataggctccggctgcggacgcataatggctgatgatcggaaacagcgtcattccggaaataaaagcgaatgaaaagacaaacacatatccgacggctttttttcggcgcagccaaaatgcggcgatgatcatgacgacctccaagaccgacagcggcagcatcaatgccggcggaatgaactggcccgtatacaggccgattgtcgcaactaacagtgtaaacacaaataccgtgataatgcgctgcataatagattgtttgctctcataagcagcagtttgcatgtcaaaagtcctcccaaaaaatgatcgtgataggtctattataaataaaatgggagaaatttgcatgattttaagaagattttaaggatgtcaggcctgacgtttcgctgcgcactcctgcatatccatgaaatcatgcagttttttcgtcaatccgccgtgcccgaatcggatatttcccttctgccccggcgttttcacgaaatcaaggaatgccagcacataaagacgcctgacgggaatcggaatgacgcccgcatcataaaaccagccgtcaattgtattgagcacgcctttatttatgccgtattgcttcgtgcaccaatgcagaaagcgcacttcgggcaggtgcagataccggctctcccggaaaggaacagttgaatgcttcatatgtaccgcctcctgtcattggctgttttttaagattgttttacttctttgcttttcagggaaaatcgatatttctccaccttatcaatttgtgtcacttgggaattatgaaccgtaatctgaacagtcccgaaatcgagcgtttccagcgcactgataatcttttcgatcacatgcggatctacgtttcctttggacgtcatcatgctcccctttatgtctggacgttcgtcttttgacaatgagtgttttaatccatactattctgataagaaatatataattatactattatgttttcattcagaaatcaacagcatttacacaattttcggatatgttttctttgcgaaaactttcacttcctttgctttgacataaaccgtgtcgccgacgcccgcccccaaggcgtcatattgctgtttttaagaacgcaatcttcacgttccgacatatttaaattgttttccgctgacaaaaaaagcgccccgcctctggacggagcaccttttttctatgcttttgcttcctcgatcacacatgtgacacccatgctggcgagcgcctgctccagagagccgtaagtttgatactctgaaaaatcaagtcccaattggatagaagtctgtgccacatcaggccgaatgccggaaaacacggttctgatgccgaggagaaataacgttttcgacagcatatacaattgctgcgccaccatcgtatcgacaatgggcacaccggacagatcaattacaaggtttgtgatccgtttggcgacacagttttccggcaccgactccaaaatcacacgcgcccgtctcgtatcaatcgcgccgatgagcggcagagtgccgatcgtatccgcgatcaaaataaccggacagctcaattcggaaataagctcctgctgagatgacagcctcgcgatcattaatttctgaaactgttcagtaaaatccgtcatcagctgatcaaacgagccgttgacaaggtaattccagcggcgggcatcctcatttgttacaatgtcctgatgctcatccataaaacgggtgaccgcctcccaaaagacggttcttgaattgccgatcgcctcaacgacctcatgaacctccgcgtcttgctccactctgcttttcgctacctgagcggcccatttttctttgttatgctgaaaaacggccggatcttccaaaaaagcgcttgcgatgaccgtgtttgtaaaggtatgctgctcgatcagcagccgtttcatttcctcacttaattgatccgcagaataaaaacgccctctcagcttccgtctcagcttgagccatttttccgtcagctctgccgaatgtgtaataatataatcatgaagtaattggtctttgttcactgccgtctcctctttcaagaatatgtacttttgtctaaattataaatcggaatcaccgatcgcactagagaaattaaaaaaacctgcacattaagcttttgattgcttttttcggcaggaggatacactataaaagaaatgaaacaggaggtcagtatgatgatcaaaaaaatcgcgacagtcgccgtatacactgatgatcagcaaaaagcgaaaacattctggacggaaaaagcggggtttgaaaccgtcgccgagcatccgatgggaccgggcgccttctggcttgaggtagcgcccaaaggggccgccactcatttggttatttatccgaaatcgatgatgaaaggcgccgagcatatgaaggcttctatcgtatttgagtgtgaagatgtctttgccgcatatgaacagatgaaaaggaacggcatcacctttttagatgaaccgaaacaaatggaatggggcagcttcgtgcaatttaaagatgaggatggtcatgtctttctcctgaaatcgtaatccgtcaggcatcttaattgactttgagaatcattttcatttaaaatgttggataaaacgtaaaaaggattggagagctgccagatgtttgtgcaaatcagaaacatgaccgtaaaagaaggacatgccgacaaagtaatcgaacgcttcagttcagaaggcgtgattgaaaagcaggaaggtttgatagacgtaacggtcctggaaaaaaaagtccgccgcggtgatgaagaagtcgtcgtgttaatccgctgggagtcagaagaccattggaaacaatgggaaaaaagcgaagaccacatcgcggcccacaaagcaaaccaaggcaagccgaaacctgattatatgcttgggacggatgtcggtatgtatcatgtcagagccgttaaaacaggcgtacacgaaaaataataaagagcatttgccccagggcaatgctctttttattttttctcctcaaacggcaggacaaacagcggtttatcgggcttccattccgcatacagcacgtcctccgtttttttgatgttcagctttttcagctcctgattcagctgcttttcttccagcccggcttctttcagattttcatacagcacttcgccgtcaataatcagcgtgaccggcaaagagacttgcttcggctttatttgcatgtcgccgtttttcgtcgtgtcatattgaaatttcggcaggacgctgaccatcccgtttgtttctaaaattgcgtactccgcttcctgtatagaaaagcaattcgcctgtctgagaaggctttgcaattgattaatgtccagcttattctttttcagcacatcatatttcagttttcctttatgtatgataatactcggctcgccctccaacagctttctggagctttttactttctgcgtaatcagttcgatgagataaattaaaaccccccataacagagaagcaaaaatgatttcaataatcctgacgcctttatcatacaccgcatttccgaccagttcgccgaggatgagcgcggaaataaaatcaaacggcgtaatttgtgagaattgagtttttccaagcaattttaaaatcacaaataaaatacccaagccgcatactaactcccaagccactgtaagtaaatgtcccatattcgcaccttcttcttaaaagtcattaccattatggacattcgcctgttttctatacagcggccggcaatacacaaaaaaacgcagacgaggctgcgttttttcacttctgcttactgtttttgattcgatctgacgacccgtaagcatacctcagcggcataaccggcggccgctccggaacccgtaaacatcgcggcaagccccaagcccatgccttcccagccgccgacaccgaaaatgctgtaaacaaccgtaccgaaagcagtcaggcccagcaccgccaaaagccactcaggccacatctttttcggccatttcttacggagcacagccgatacggcaaagttaagacaaaatgcggccagacagatcagataaaaaaaccccatgtcttttgcacctccgtcatgaggagctttttatttgctcacctttttttcaaacaaatgataacccggcgcgagtccttttgattcgtaacccattccgctgtaaaacgactgaagcgccttgtttccggacacgcagtcgagccggattttcgtttttccaggacaagacaccccgtctccgcccaagtcatgatcgtccggccgagccccgcccctgcaaaccgcctgttaatcgccagccggtggagatatacggactcctcatgtccttcatcgccccatagacgtctgtcccacccgcttgcttcgggaagcagcatgacgacgccggccagctcttcattctgcctgaataaaaaaacataccctttggcgatcgcctcccgcatattgtgggtatcttccccttgcagaaggccgctccactggttcgaccctttatcgcgaagccattctgccgcctgcacgagcagatccatgacttcttcttcatcatccttccgggcggaggtgacccggaatgcccccgccttctcctccgtaatcgtaaatggtgtcataaaatcctcctgtaatcagaatattcgacacctttattatagaccaaacgcagaaaggaaaaaaacagccgtcatgtttgagggccgtttaaaaaattttcttcttatcacgttcttcttttaaaatctcaaccgcttccctgaaacgcatagagtgaacgatttcacgctcacgcagaaaacggagtgaatcattcaggtcaggatcatcggaaatatcaataatccattgatacgtcgctctcgccttttcttcagccgcaatatcctcatataaatcagcaatcggatctcccttcgcctgtatgtaagacgctgtgaacggaacgccggccgcattgtgataaaacagcgcgctgtcatggttgacgtaatgatcactgagccctgcatcacgcagctgctccggtgtcgcatcttttgtcagcttataaatcatcgtcgcaatcatttctaaatgcgcaaactcctccgtgccgatatccgtcagcaggccgatcaccttgtcaggaatcgtgtagcgctggtttaagtaccggagcgctgcggccaattcgccgtccgccccgccgtattgttcaatgagaaacttagccagcatcgggttgcacgtactcactttaaccggatactgcagctttttttcatatacccacatttacagatccctccttatacttgccatggccaaggaccgcggccccagtcccattgagcgccggcctgactcacgccgaattgcagaagcggtccgtactcaggctcaaaccgttttctcagctgccttgagtaccgggaatattcatgaaactgctgaagcgcgagacggtcatggggatgcgtatccagataaagcgtcagctccaccaagacaaagtccgccgcctgaatttgctccagcagccgatagtattcatcatcaatctttttcgccatattcgattcccccccgataaggattatcatagaaatcgtaaagatccttccaaagggtcccttttcttaatgcctccatcggagaaaactgctccaagtgataaggctgaaaccgcatataaagatgcggcggcgttctgtagtattttctcccgatcggcgggcagggatcaaaccggctgtggaagggtttataggatttgaccggtgtaaacggctgattttctttcattacgatcctcctttcctaaacacatgaccttaataggtatgaatccgtatcagcatttatgccctgtaagaaaataaaaaagcccgttaaaaacggactccatgcagctcatctggaatttgaagtaaaaaaatcataatgaaaaatctgattgaaagcactgataatgtttcaatgtatattccgtaatttgctgatcatattcaggatattcgtatctcaataaaacagccactgactttgaatatgctctgaagagaccttggcagtcaaacaatgccttccacacgctttcataagtattgccgacataagtattcagcagaatttcccaatctttcgcattcatgtaatgttgaatatacttataattcttccctacacttaatgaaaactgatgctctatcccaatattccacgcaatcatacgcaaaacattaggccttaaaatgtcattcatatggtccagcgcaaacagtatttctttgcgcattaatcctttaatcacataggttgaaaccatccaaaattcattgcagcaatcatcaaactctccgggggtcggtttctttatatgatattgttcatcactcgcaatcatcttactgttgattcggtcatccttgtctaataatatttccgccaaaccatcactctgtgtaaaataatcctctgtttgactcagagggatcaaagttaagtcgattttatgatgatctttaaaaagcatgagataggagaaccagtctccgagttccggagggaaaagttccatatcttcaggtttttgcatcatcattctttcgccaaactgatccagccagctttcatcagatataaaagagtccatatcggtcacaaaataagaaatatcatagtcttgaaatttgtctcgcggtacatttttattggttcttgatccctctaaagtgacaagacggattctctcgtccttcatcgcaatatcaagaatcaatttcatcatttcgtcttcacttctcacatgtaaaacctcccgataaagagatttttacagatcatgcttttcagtttataaacaacttgctcatgatttacagaaatgtcatatgtacttgatgattttgctccaatcgtaccacagctgcaagaacatgagaagagcactcttgctgttccaagagtgcttttcccgaatggtcagatatattggctgtcccgatgatgatggtgatggaacgggtagccgccgtagcctccgccatagccgccaaaaccgtaccccggatatcctccgaagccgccgtagccgccaaaaccgccgtaaccgccgtaaccgccgtaaccgccgtaaccgccaaaaccgtaccccgggtagccgtagcctccgccgaaaccgtatcccggatatcctccgaagccgccgtagccaccgtagccgccaaaaccgtaccccgggtagcctccgtagccgccatagcctccgccgtaaatcggtcttctttcattcatgatttatcgctccttcacataggttacagtccagtttatgacatgcggaaggaaacgtatgggcatccgcccagttttggcgaaataatcaataattgcttacggagaaatacgatacaggccggccgcataagcaaaataaaaaggccggaacttatgccgccccggcctttttgtctttattcgcctaaatctacattgtgataaacctgctgtacgtcttcgaggtcttccagcacatcgatcagcttttcgaattgagctttcgcatcttccggaagctcgacttcattttgcgcaagcatcgtcagctccgcaaccgtgaactcttcaacgccggcatttttgaatgcctcctgcacggcatggaattgatcaggctcagcatacacgataacactgtcatcctcttctaaaatatcgcgcacgtccacatcagcttccatcagcaattccagcgcttcatccgccgtcttgccttcaacgccgataacggcggtcgcatcaaacatgtaagcgacagacccgctcacacccatatttccgccgtttttcccgaatgcggcgcgcacttcaggcgccgtgcggtttacattattcgttaacgcatcaacgatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaacgcctggttcgattccggatctggctcgccttgttttgccgccacataaatctcacggccgaacttcgcgtaaatccggctcgtatttgcgtcctttgatgctttcttttctttgatattgttccacttacggcccattttgttccactctctttcacgaattgaatctgtatgataaatactctgcttctattatacctcagcggttgggttgtttcgagtgtaagacattagaaaaaacaggcacgcttaaaatcaccggagcgcagtaagccgaatttgaggattattgtacaaaacataaaaaagcctcccttcatacaggaaggaagtcgcaagtcaaaagattcattttattcttattacctatttcctacactgtatatcctgactcccgtggtaaaattttgatatcgaacaaaagaaaggatatggtcatgaaagttttcgaagcaaccaccctgctggccgctgccaaacagcgcgcgggtgaatacaaaaaactgcgcggtcagatggttaatctgaaaaaagcatttcaaggcgtggctgatctcggtgacggcgatttctctggtcggggcgcagataacatcaaagcctttttccaggaccacgccggcgtcacagacagctggcttgatctgatcgacatgaaaatcgcatttctcacaagccttcccggtaaggtcgaagatgccggactttccaattcgcatgtggaggaatcatttctggagcatgagctcacccacgccctcagtaaatcaaaggcgattatggaagagcagaaaaaggacatgcgctccatcctcggtgagatcgatgacatcatctcgcttgatctgttttcaacggaaagcacagatcagaagctttcttcagctgacaaaaaaagaagcgaaacgatacataagctcggcaagcttgatcacgatctaacgaaagaatacgcagaaaccgaagcgaacgaacagttcatccaagctgacttccagcagcttcaaaatgccacgggcaaaggaaaaagcgccacgccgcttcactacaacgccaaggcgtaccgtgaaagcgacatccataagaaaaaaggcgagattgcaagacattcggatgcttatttgaagatgaagaaagaggaagcgaaggaacgagagattgaaaaactgaaagaaagactgaaaaactacgattatgcgaatgctgatgaattctactcaatggccaaaacaatcggctataaaaacctgacaaaagaacagcagcgctacttcactcaaattgaaaacacgcgtgaacttacagacggtttcaaaggcgttgccgtcggcctttatgattccggaaaagacgcggtcacaggcctgtgggatattgtcacagatccgggcggaacggttgaagccattacaggagcggcggctcacccgatcaagacgtatgaagccatttcagcggcaatcgaagaatcgtaccaaaaagacatggtgaatggcgacacctactcaagagcaagatgggtgtcatatgcagtgggcaccgttgtgacatcagttgtcggcacaaaaggcgtcggcgccgtctcaaaaacaggaacagccgccaaagtgacaaccaaagtcaaaacagcagcacgcaaatccgccgcagcacaaaaagcgataacggtctcaaaacaaaccgttgatcacatcaaacaaaaagtaaacacaggcatagaagtatcaaaaaaacgtgtcaaaaccaagttacatcaaatcggagatctcaccctggctgatattctcccgtatcatccgcgtcacgacgtagtgccggcgggcgttccttacaacgcagtcaacggggtcacacttaaagaaggacttcagaaattcgccaaggtcatcctgccgaaaccgtacggaacctccgcaagcggcagacggacaccggcaccgcatgtaccgccggtaacggtcaaatacggcgagcattttgcgaaatggaccagaaagaaagtattgaagccgaatgtcatctataaaacaaaagaaggctacacgtacaccactgacaactatggtagaattacaagtgtcaaagcagacttgcagctgggagaagcaaaacgcaaccaatatgcgcaatcaaaagcaggtaaaccagaccgtctgacagatgacgacggaggccacctaatcgccacccaattcaaaggctcaggccaattcgacaacatcgtgccgatgaattctcagattaataggagcggcgggaaatggtacaaaatggagcaagattgggcatcggctttgcaagcagaccctccccaaaaagtatcagttgaaattaatgcattgtataaaggtgattcattaagacctactgcttttagggtgaaatataaaattggtgatcaagaagctaaacttatgagaatcaaaaatcaggccggaggttaatatggagacaaaaaaaatggggcaattatatcaaaagatagcagaaagcattaatgagatcattccatctgaatgggaaagagttattctttatgcagaaatacttgacgattcatctgaagttttcttttatttcaatactccacatagtgaagattttatatattctcataatatccctgaacactatcatgtcagtgaggagatttatgaggagctgttatttgacttgcatgacttattcgaggaattacgagatgaatttaaagaaaacaatcaagatatatggactaatctaacacttaatctggggataagcggagaattttcgatagactataattatgaagacgttattcaatctccatataccatctctcaaagacaaacaatctggacttataaaaatgtaggaatttatcctaagagtaaacctttaaaatcctttttagaacagtatttaaattctcaaaattaaaattccccctcctttattggggggtttttttgatacaaatgatccttacaaattaccaattataatgctggaggctgatccttgttggaaaatgaattaaatgcattatatagaaacatagctgaaatcgttaacgaaatgataccagaaccatgggagaaatttttgttctatgctcagattcagagacaggcggaggcacttactttttttacaattctcaaaatgaacctaattattttaagtacagtcttgaaattccgtttgaatttgatattgacgaaaatgaattcgatcagtatgagatggaattatttaaactaagcgaaaaaatgagagatgttttcaaagatcatgatcaagaattattttattctttcactcttagcctagaaagatccggaaaattaactgtcaactttgattatacagattggtttaagacagattatagtttcagtgatcagcttatcatctggaaattcaaatacttaagggaagaacctaaggatccatcattacaaaaattaataaaaaaatatttagatgaatatcctgaaaatccaatttaataaagttgggataatgatgttagaaaaagcttatctaaaaataactgatgtcttaggaaaaataattccttctgaatggagcaaagttgttctgtatgcagaaatactagacggttccagagaagtttattttttctttcaaacacccgaaaacgatgaatatatatactctcatgacataccagaacaatttcaggtcagtaaaaaaatttataccggactactactagacctccaagagttgtttatgcagttacacactgaatttaaagaaaataaccctaaagcatggacaaatttgacactgaatcttgaaagcgatggaacgttctcaattgattatgattatgaagatgttattgaatctgatttggacgaatacgaaagacaaatgatttgggagttcaataacttggggattttccctgaagacgaagaggacaaagaatttgttaaggattatctaaatattaaataatgctatcaacaaaggtagaggatcatcaatggtagctgaaaaaatggaacaactatatcaaaagattgctgaacatctaaatgaaatgattccatctcaatgggaaaagatcgttttatatgctgaaatacttgatgactcagcggatatatacttttattttacaacaccaactaatggtgattacttatattctcattatatacctgaacaatttaaagtaagcgaagagatttacgatcaactgctgattgaacttcaagagctatttgaagaactaaaagaagaatttaaactaggcaaccaagatatttggactaatctcactttaaaattagaaaacaccggaaagttttcaattgattataacgatgaggatgttttattgtctgaacttgatgaccttcaaagacgagatgtttggaaatatcaaaatttagggattttgcctaaagatgaggacgatagaaaattcatagaagagtatctaaacatataataagctttcaaacggctaaaaaaaattaaaaaggattctgatattgtggaaactgaaaaaatgggcgaactatatcaaaaaatcgctgagcaaataaatgaaattatcccctctgagtgggagaaggttgctctttatgccgaaattttagatgattcttcagaagtttacttcttctttagtactccacaaaatcaggaatatatatattcacacgatattcctgaacattttaatgttgatgaagatatatatgacgaacttctatatgaattgcaagattactttgaagagttacgggatcaatttaaaacaaacaacgaggacttatggacaaacctcactttgcatctcgaacgaagcggtaaattcttctcaattgactacgattacaccgatgtcatcgcctcagacttaaacggaacacaacggcaagtggtatgggaatatcaaaacttggggattttgcctgaagatgaggacgataaagaatttgtaataaactacgtcggtctataagtcaataatggctcagcacttccttgctgggctattttttataactacatcataccttatgaatgggcaaaaatatatctttatgcagaagtattagatgactctcccatggttctctttcacttcaagacaccaaaaaaacgtcaactgatttattcgcaagatctaccagcctgatacagtgtaaataaagatatcttcaacacttttcaagagaaatccgagaactttttgaggaattaagaattgagcacaaaaagaataatgataaacaaaacaggcagcatccagtaaacggatgctgcctgttacatcgttatgtatcgtctgaagaagtcatttattttgttttttaaatatgaaaatagatatgacggtaaatatgatggctgtaatgacaatgacccacaagctcgcagccgtactgataaaatggccgtttaacttgtagacgatcccgtaatgcttttcatattcctgtatttggtccgcagaagcatgtttaaacactttatcaactgagtctgtcataaacgcttttctgaacagaacggcggtgtggctgatagggaaatacataataatcttctgcacaaacaccggtacgccgccgatcggtacatatactccgcataaaaaaccgatggctgttccgacaatcgtacttaacgtcgaaaatgcattttgtgtgtgaataaacagcgttaaaaataaatttatggaactcgagagtgcaactgaaagaataatgatccccaatacttcaagtatatctgtaccgcttaaaagcttgctgcctgttgaaacgagaaaaatttcacagcctaaaaaggcgatgaaagaaaagatcaagccgatgacaaatgaatgaatgacatagctcaattggatggtcgcccttgataaaggagctgttaaaaagtcatacgttctcttgctttctttatctttcaccataattccgaaagcgcctaaagtcgttgtcacagctgtaatggacagcaatcccgccaccatccattcgttcaccattgctttggaatcatctgtcgaaccgaccagggccttaatggcgtccagctgtgtctgctgtaagaacacggcatataacagaatgacgataaatactgacagcaaagagagaagcaaaagcgttcgatcacggaagtatatttttatatttctgctgattaaactggataaagacttcatttatgcaatgctcccctttactggcaaactgcttccttgttcttcgataatatggataaacacatcatccatatttcctttaatcacttcgaaagattcaatttttccttcaagacctttcaaaatgtcaaacgcttggagagtggactctacacgaagggaataaatagagtttttaaccgtaaaatccagttgtttattttcaaaccatgccgtcggatcaacgccttgcttaaacatcatatgcagactgtcaaacgcatattgatctttgagctgactcggtgtaccctctgcgatcaggcgtccttctttgatgaccacaacgttatcagccacagcggcctcctccatgtaatgggtcgttaaaaagatcgtcatgtttgtttcttcctgcagccttttaatcgcattccaaacaaatactctcgtttgcggatcaagacctgtagtaggctcatctaaaaataatatagtcggtttatggatgatggcacgggcaatatccgctcttcttctttgtcctcctgacaaatcgctgtattttttctccttaatatcatccaattttaaatagtctgttacaaactgatagttctcttgcacttgtgccttgcttaaatgataatattgtccgcggttcatgatattttcataaacggtcaatcgttcatccaaaatgctctcttggaaaacaactccgatctttttgcggatatgattattctctttcccctcaccaagagtataaccatctattaccacttttccggatgtctttttaatcagcgtacagagaatatcgatagtggtcgatttccctgcaccgttcgttcccagaaatgcaaacagctcgccgcgtttgacagaaaaggatacccctttcactgcttcaaatgatccatattttttgcgcagatcggttactgtaataatgtcttgttcttctcccattctgttcacctcgaaaaataagattctataccgttgttcactaactttatatcgtcattcccgccaggattttctcatttttatccaaatttattatctttttataaataattatcttgattatgaagatatacgtacataaaaaggcttcttaaaagaagccttttatcgctttacgttaatattatgctttcattccccaagtcattaacaatcgccactttgttaagaagctttgtaaggatctcctacacaaatagatttttcttttcctgcaacaacggtagaaatcctagtcgcattcgttaaaaagcctttaacagttgtcgcaaaatcttgcctccctgctttttaaaggtacaagatcatagcgtgattttttcccaattccgttttaataaataattaaaaaaggtttcatttgtgcttatatgtggctttttcttcagcaactgatgaagacttaaagaactcattctctttgtaattcatttgcatatgtttcagccttttaaaaaagtaattttctaattgtttgtctatacaataaataaaacagcctttttgtccccgggtcatcaaagttctgtatgtgttgcgaataatttcgtctgcaagcttctcagcttcttctgaattttgctttagcattttcttcaaaccacgtaaggaggtatctgttttcgcccgctttgaatgatcagtcaatactactccgtccctgcacactagatcatttcctataattacacctacataatcaaattccaaaccttggcatgtgtgtatacaacctatttcattaatagaatcttcatcaattgcccacgtgtctgagttatttaaattccaactcattccgaattgatattcaggaatctcgatatcatgaaattctgttttagctttgccttccttcacccaatcccaacagtaaccagcaactattcgagctttattattaactttattcagatcttctatctgtttacgcaattcatttggatttctatatatacgaaaatcgtagttcattccaatataattagaattcgcagtttcccgaatttgaagaacatcatctaaccagcttatataaccatctgaaccattgcaacgaaactgtgaatccagtttcatatttgtaacctgagcatctaattcttttgagaatttaaggattgtatcagtgctaccaatatcttttaatgttactctttgatgttcgtctatgaaaaaaacagaaagtttggaagcatttattatttccttaatttgattttccccaaggttattaaataaaccggatttctcatttaatcgatgcgcctcatcaacaattaaaacgtcaaattcacctgatggagcattgacataactgcccgatcctttaaataaattatcaatgtgccctttccgaaagttttgttttaacttagtagcatatatatttctgggagctgcattttttgttacatattgtgccacaagacttcggtttgttgcttctactaataaatttatagcaagaacagattttcctgtacctggtccgccttctacaattaatacttttttagtgtttgtacgtaatgcctcattcgccaaatgtaaagccgtctcatacacaactttttgattatcaatcatcataaattctcgattaccttgaagcatactgtttaacgaatcttgaagagactttgaaggccttattcttcctttatctattgtatataggatttctttgttgtctccatacttaatatactttttaatgaaatcacgaagcttacctgaatcacctttgataaaaacaggagcttcttttatataatattcatatattgaatcagttaatggatcgtctgtaccctgattcaagtagttatgtaagtatgcacaaggatatagcttgatatcttctttttgcgcattttcattgtaatcctttattaacgaagcgtatgaccaggcttgataggatgggtgggttgtttcgcgaattcctttatttataaacgttttaacgatggcctctttactatcaattttctctactttctcccattgtttaagttccacaatcacaacagatgaacgatcatccttatctgatccagatataagaaaatcaatacgctttgaagtatggggtattttgaactcaatagcaattcctgcgtccttaggaatttctctatcacttaataccctatacatatactgcatagagttatcccaagatctaacctctttctcattgattttgccaatcttatcattatagtttttacagatattcgtcaccaaattgtcgtcaaacacatcactcagaaactcttcttttgtagcttcatagactatcattgtttcaccttttcattaactttttgcgttatctctataaattcgccgctcaaaataactaaattgagctatattgagaataccatttttcttcaaattaatctgttttaatatgacctttgtacttaataattaaaaaggatccttcacatattaatataaaaagcagcgttctccaaaagagaacactgctttatttcaatactagctttgccacacactccacatgattcgtatgcgggaacatatccaccggctgcacttcgagcgtctgatacccgccatcctcaagcacccgcaggtctcttgcaagcgtgcctggattgcaggacacatacaccacccgcttcggtttcatgtcgatgattgtccgcaggagggcttcgtcgcagccttttcttggcgggtcgacgacgagcgtatcggccgtgatgccttcttcataccatttcggaatgacggtttccgcttctccgactgcgaattccgcgtttgtgatgccgttcagctcagcgttgcgtttcgcatcctcgatggcttccggcacgatttcgacgccgtacacttttttcgcctgcttcgccagaaatagagaaatggtaccgatgccgcagtaggcgtcgatgacggtttcttctccttgcagctctgcgtactcaagcgctttgtcgtagagcacttttgtctgttccgggttgacctgatagaacgatctggcggagatggcgaatttgacgtctccgatgaggtcgtagatgtattcttcgccccagatgacgtttgtttcgtccccaaaaatgacgtttgttttatttgggttgatgttttgcacgatcgatttgacgtgcgggaattgcgccgtaatgtctttgatgatcttcgctttgtgcggaaaatcgcttgttcttgtgatgaagacgatcatcatttcgcccgtgacgacgccgtatctgaccatgatgtggcgaagccagcctttgtggcgttcttcgttataggctttgacaccgtatgctgcacagatgtctttgacggcttggacggcttcatcgtttttggattgctgaatcaggcaggcgctcatgtcgatgatgtcatggcttctttgctgatagaatccggcgacgagtccgccttctctttctcctaccggcacctgcgctttgtttctgtagttccacgggtcttccatgccgagcgtcgggtgcacggtgacgtttgagaggtccagcttgccgatccgttctaagacgtctttgacttgtttctgtttaaacaagagctggccttcataggtcatgtgctgaagctggcagccgccgcattgcttgtagatcgggcacggggcatccgttctgtgcgggctttcttccttcagctcgatcaaacggccgaaagcgaagccttttttgacgcgtgtcactttaatttgcgctttttcctcaggcagggcgttcggcacgaagatcgggaagccctgaacctttgcgacgcccgctccttcatgcgtcaaatcctcaaatgtcacgtcatagtattcatttttttctatcgggggtttcattttcatctataatcacctctcgttttaccaaaagccttgtttcagcgtgctggcaaaccttcaaattcaatgtcagccttcaaaggtttccgatcacgctgaaaagatgacaaaatcctaaaacgaatactgttttaggattttgtccgcgtattagtcatccagctgttccgctttctccttcggcatgatgacgtgaatatgccggtacagattcacgaattcgcccggcagcatgccgccgtattcgccgtccaggttcagctgcatcttttctgatacattgactttcacacggttcgcttttgtgtaaataatgtgctgatcgttaatatgatcgcctctgagcgccatgctcgcgactctgataaactccgcgagattggcttttttcaaaataattaaatcaaacatgccgtcattcaggctggaatcaggggccagcttctcgaatccgccgaccgagttggtcagcgtcactaaaaacagcataatttcgccttgaaacagcttgccgtcatattcaatctcgacttctgtcggtcgaagtgaaggcaacatttccattccctttaaataataagcaagctggccgagcatcgttttcagtttgcttggcacatcgtacgtcagctccgtcagacggcctccgccggcgatgttgataaaatactgaccattcacctgtccgatgtcgatcgggcgggccacgccgttaatgacggtatcagcggcattcagtatattctctctcggaatgcccagcgctctggcgaaatcatttgtcgtgccgaccggaatgatgccgagtgtcgggcgtttgtctaacggcgcaagaccgttgacgacttcattaatcgttccgtctccgccggctgcgacaatcaggtcaaactcccgcaaagcggcttctgttgcggcgtgggtggcatcccccgcgcatgtggtggcatgggtggaggtttcataaccggcttgttcaaatttttgcaggacctgggcaagatttttcttgaaaagctcccgtcctgaagtcggattgtatattatgcgtgcacgtttcattatctcatcatcctacttaagagtatccgatccattattaacactaacaacctttaattatactatgacttgagaaaatcgcaacaatatgtacaggaattgccagaagaaaaaaggccccggctccgtttaaggagccaaggcccgctgtcttactcttcttccgttccaggttttttcttacggaatttcgctaatacttcatatacgatcggcacaatcagaagagtcagcagagtcgaactgattaaaccgccgataacggtgacaccgagtcctttagaaatgacctggcttccgccttcaaagcccaatgccaatggaagcagggcgccgattgtcgcgatcgccgtcatcagaatcggacgcaatctcgtagagccggcttccaggagcgcttctctcgtcgataggccttccgcttctttatggatgacgcggtcaattaagacaatcgcgtttgtgacgacgattccgatcagcatcagcataccgatcatggcattcagactgaccgtctctccggatacatacagtccgactaatgcgccgatgactgtaaacggaagcgagaacagaatcgcaaacggcgctaatgctccgccgaacgtgatcacaagaacgaggtatacgatggcgattgcggcaagcatcgctaacccgagtttcgtaaaggaatctgcaatatccgctgatacaccgccggtatcaatcgatacattgtccggcttatccagtttgtcaactttcttttgaacggctgatgacaccttcgtgacgttgtcagaagtgacggttgccgttacgtcagcgtacactttgccgtcgcgtttggaaatggtatcggatgtcgtgccgtttttcactttcgccacatcgccgattttcacttcttggcctgcaggtgatgtgatggttttatcctctaattcttttacactcttatactggtctttttctgttttgatgttgacgtcaagctctttgccgtcttttttcaccgttgtcaaaggagactgtgacgtttgggacatcagggcttgggagatttgcgaagccgtcaggccctgcttgctgagtttctcctggtcagcgacgaacgtgtactcatcatatgtgctggaaaggcctgagttgacgtctttcagatccttctcctttttcatgatgccttcgatgtctttgaccgtgcctttaatatcagactctgaatctccgtacacatagtacgttaattcgttgttgttgcctgacgaactgaaattttgtgatttccattcgccgcggctcgatgtttttttgatttcttttaagacattgtctttttctttgtcaaaatcaggcgtgtcatcctcgtatttcacgtagaacaatgcgccgtttgagcttccgccgagcggactttgcgatcctaaagaatactgaacagtatcgacatgtttgcgtttaagcagcatatcttccgctttttgcgcagctttttcagcttcgcttttcgtttcgcccggttcaggcgtgtatgtgagctgcatcgttttgtccgcttgcgcaggcaggtagctcgcgccgatcagaggtacgaggaacaaactgccgacaagcatcagaaccgcgatgatagatgtaatccatttatggcttaatgaccaattcagcacttttttatagaaattggccaatctgcccggcttatgctctttcgctttaacaggtgcgcctgtgagcgattttttgaataagctgtgcgcaagcatcggcaccagtgtgatcgaaatcaacagtgatgcggcaagcgcgaagacgattgttaaggcaaacggcataaacagttcgccgatctgtccgccgaccatggcaagcggcaggaatacggcaatggttacgatcgttgatgacatgatcggtttaaacatttcttttgtcgcttcacgcaccaattgcttcccgcgtaaaggttcatctttcagcctcatgcggcggtaaatgttttcgatcacgacaatcgagtcgtcgactacccgtccgatggcgaccgtcatcgcaccgagcgtcattatgttcaatgtgacatcaagctgattcagcacaagaagtgcaatcagcagtgacagcgggatggaaacgatagaaatcatcgttgatttaatatctcttaagaataagagaatgatcacgaccgcaaaaatcgcgccgaaaatcgctttgcttaacatcgtatccactgactctgtaatcggctctgccatatcaagagtcgagctgtacttgaaccctttatggtcttttttgtattgattcagttcatctttaatcgcatcggccacttctaccgtgttggcgtcattggcttttacgatattaattccgatgctgtcctttccgttcgtgcgggaaatggattcagcttttttcacatctttaatgtcggcaatgtcagagagcttgactgtcggcacccctgctgacgcgctttgctgtgcctgctgcatagcctgagcgtccgccgcagatgccgcaccggctccgcccgcttgaccttgagcggcagaagaagatgtgaccggaattctcatctctttcagatctttaattgacgtaatatttccgttaacgacaactgatttttctttgttgccgaatgtgtacaatccaagcggcgtattgacgtcagagccttggatcactttcttgacggtatcttcatcaagtccgtactctttcatttttttatctttgaaagagaattccacctgctcttcctgctgtccggaaacttgtacggacgcaacgccctgaatgccttcaagcttaggaacgagagtgttttccacatttttagtcagatcttcaagcgagcttttgccgcttgtcacactgagcgtcaaaatcgggaaagagttgagactgtaacgggaaatgtcaggttttttcgcgtcatcaggaaggctgacactgtccagcgcttcagcgacttcggttttcgccttgtccatatccttgttgtaatcatattcaatcataaccgatgagacgttttcagaggatgtggacgttacgacgctcactccttctaaattctgcaccgcctgctcgatcggttttgtcacgtcatccgcaacttgactcggagcagctccgggataagtcgtatttactgagaggtaaggcatgttgacgtccggtatggattcctgcttcatattcagaccggcatacagccctgctacagtaacgataatcgtcatcagccaaactgcgaatttgttcttcagtacaaagttaataatgtggttcatcatgtcctccgttaatttttattgactgactggtcattctatataatactaaacggtataactcaacatcgtcaactaataaggcagtaaatttttctaaatttttcaggattaaggggaagcacgtcatgaacgaaaaaaaagagaaaatcataaaaacaggcatccatttatttgccaaaaaagggttttcttcaacaaccattcaggaaatcgccggtgaatgcggaatttcaaaaggggccttctatcttcattttaaatcaaaagaagaccttttgctctcagcatgtgagtattacatcggcatgtctatggaagaaataaagaaaatcaaaacagaacatcagcataaatcgcctaaggacgtattccgaaaacaaatcgcttatcaattccaggaatttatggagcacaaggactttatcattctcttgctgagcgaaaaggtcattcctgaaaatcaaaaggtcaaacagtattttcatgaggccaatattcaatttaacatactgtaccgggatgctttgctctccgtttacagagatgccgtcataccgtttatagcggatgcgtccgttatggcgcaaggaatagtgagctcctatattcatttcttgatttttaatgaacatacggcattccggacggaaaacgtggcggcctttctgattgccagaatcgatgacctgattacgggactgataagagacaatcccgatccgctgctgccgcaggatatcttcactcagccggcggcggacagagaaagactgcttgcggatattcaaaagataaaagcacagcagggctgcctgaggacgtcctcgtatcgcttgaagtcattgaagaggaatacgcaaaggaagagccgcgaaaaccgattattaaaggaatgctgtccaacttggcaggcagcggaaatgagcagattgaaacgctgcgggcttccattgaaacctatttcagcttataaaaaaagagaccggcgcttaccggtctccgtgtcagcagcgcccttagaggcggctgctttttttatcgttttttgatttcttcaagtaagatcttgttgaccatcggcgggttggcctgtccttttgaggctttcataatctgcccgacaaggaagccgatcgcgcggtcttttccgtttttgaagtcttcaattgactgcgggttgctgtcaagcgcatctgttaccagcttcagaagcacgctttcgtcagaaatctgcacgaggcctttttctttaacgattttttctgcgtcgccgcctttttcaattaattctttaaagactttcttcgcgattttggacgagatggttcctttttcaatcagcttaatcatgccggcaaggccttcaggagtcagtgcgacatcctcaagctctttttgttcggcattcaggtaagctgacacttcacccatcagccagtttgatgcctgcttggcttccgcgcctttattgaccgtttcttcgaagaaatcagccatttctttcgtcagcgtcagaaccattgcgtcataggccggcagaccgagctcttcgatataacgcttgcggcgctcgtccggaagctcaggaatggttgctcttacgcgttctttccattcgtcatcaatgtagagctcgacaaggtcaggctcagggaaataacgatagtcgtccgaaccttctttgacacgcatcaaaatggtttttttcgtcgcttcatcgtagcggcgcgtctcctgctgaatgactccgcctgacagaagcacctgctcttggcgtttctcttcatgctcaagtcctttttgcacgaacgcgaaggaattcaggtttttcagctccgtttttgtgccgaatttctcctggccgatcggacggagggaaatgttggcgtcacagcgcagtgaaccttcttccattttacagtcggaaacacctgtgtattggataattgatttcagcttttcgagatatgcgtaagcttcctcaggtgtgcggatatccggctcagatacaatctcgacaagcggcgtgccctggcggttgaagtcaacgagggaatagccgtcgcccgtatgcgtcagttttcccgcatcttcttcaaggtgaagacgggtaatgccgatttttttcgtttttccgccgacttcgatttcaatccagccgttttcgccgatcggcttgtcaaattgagatatttgatatgccttcgggttgtccgggtagaaatagttttttcggtcaaacttcgtatccgttgcgatttcacagttcaaagccattgcggctttcatcgcgaattcgaccgcttctttgttcaaaacgggcagcacgccgggatagccgaggtcgatgacgcttgtttgggtattcgcttccgcgccgaatggcgtcggtgagcttgagaaaattttagattttgtttttaattccacatggacttcaagtccgattaccgtttcaaagttcacttcatttcaccccttacagttcaggtttcgctttatgatgatctgttgcctgctcaaaagcatgagcgacgcggtatacagtgctctcatcgaagtgttttccgatgatttgcagtccgagcggcagtccgtccgcaaatccgcatggcacgctgattcccggcacacccgcgaggttgacagggatcgttaaaatatcgttggcgtacattgtgagcggatcgctggttttttcgccgattttgaatgccggtgtcggcgttgtcggtccgacgatgacatcgtatttctcaaatacgtcttcaaaatcttttttaataagcgtgcgcactttttgcgcttttttgtaatacgcgtcatagtagccggagctgagcgcgaaggtgccgagcatgatgcggcgctttacttcgttgccgaagccttctgagcgtgtctgtttataaaggtcgatcaggttgtccgcattgtctgagcggtagccgtagcggatgccgtcaaagcgcgcaaggtttgcagacgcttcggaagaagaaagcagataatacgttgcaagcgcgtatttgctgtgcggcagagatacttcttcccatgtcgctccgaggtcttcaagcacttttaaagcggctaaaaccgattctttcgcttctttgccgacgccttctccgagatattctttcggcacggcgatttttaagcctttaatatcgccagttaatgaagaaagaaagtccggcacttcgacattggcgctcgtagagtccattttgtccgggcctgaaatcgcctgaagcaggaatgcgttatcttctacgtttcttgtgatcggtccgatctggtcaagtgaagacgcaaaagcgaccaaaccgtaacgtgacacgcgtccgtatgtaggctttaatccgacgacgccgcagaaagaagccggctgacggatggagccgcccgtatcagatccgagtgaaaacggcacttctccggctgcaaccgcagctgcggaaccgccgcttgatccgccgggaaccgtatcgagattccaagggtttttcgtcgctttgtacgcggagttttcagtagaagaacccatcgcgaactcgtccatattcagcttcccgattgtgacggcttcagcggcttgaaggcgttccacaaccgtcgcatcgtaaatcggatcgaagttttcgaggattttgcttgagcatgttgtgcgaagccctttggtcacgatgttgtctttgacgccgatcggcattccgaagagaagaccgtgttcagaccgtccgtcaaccgcttcgtcaagttctttcgcgtaagcgcgggctctttcttcatcaagctgtaaaaacgcctgcaccttatcatccacggatgcgatccgtttgtaagattcatcaacaagatcggaaatcttgatttcttttttatgtatcatttgtttcagttctgtgattttgtgatcaaataatgacatactgtctccctcctttaatccagaatagatggcacacggacatagccgtctttatgatcgggagcatttttcatgacatcctcgaccggaaggcctttacccgcttcatcttctctcattacgtttttcattttcagcacgtgtgttgtcggttccacgttatccgtgtccacttcattaagctcctcggcaaacgagatgatgctgtcaagctgttctgtgaacatttcagcttcttcatccgtaatggcgagtctcgccaaatgagcgacatgctttacttcttctatagaaattcgtgacataagatccacctccgcataattctccgtttcgtcatataatactgatcatatcaaaaacgagccctctaaagcaacaaaacgccgccttctgaggcatgatgaaaccctctctattttatcctaaatcggggagaaagagaaacgaattatatgtcagaaaatttttacttttataatttattggtagcgctttcttctttaagctgttctaggttggcggggattttttccttgagcgggccaggtttcgagagttgattgatcggggatactttgttaggtttagtaaccatagccggcactaaatcatgcgatccccatcgaaagatgactaaaggcaggctggatcgccggcactactaatctacagaggtgatgcaacatttacatgaaagaagagagggtccaaaaacgtgagtattgaattaattatatctcttggcatttactttgccgccatgctgttaatcggctggtacgcattcagaaagacaacgaatattaatgattacatgctgggcggaagaggactcggtccgttcgtaacggcgctgtccgcaggtgcggcggatatgagcgcatggatgctgatgggagttcccggcgcaatgttcgcaacggggttatcgaccttatggctggcgctcggtttgacgatcggcgcgtattcaaattatctgctgcttgctccgaggctgcgcgcttacacggaagttgcggatgatgcgattacgattcccgattttttcgataaacgattccgccactcgtcatcattgctgaaaattgtttccgccgtgattattatgatctttttcacactgtacacatcgtccgggatggtatccggaggcaggttatttgaatcggcattcggcgccgactacaaattcggtttgtttttaacggcgggtgtagttgtgctttatacgctgtttggcggtttcctcgctgtcagtctgactgactttgtacagggagcgatcatgtttgcggcattagtgcttgtgccgatcgttgcttttacccagctcgggagcgtttcaacgacgattgattcgatcaacgccgttaacccgaaactattggatatctttaaaggcgcgagcgtcattagcattatttcttatttggcatggggactcggctattacggccagcctcatatcatcgtacgatttatggcgattaaagaagtgaaagatttaaaacccgcccgcagaatcgggatgagctggatgtttatttcagttgtcggctcattgctgaccgggattatcggggttgcgtattctcatcacttcggggtctccgtaaaagatccggaaacgattttcattattttttctaaaatcttgttccatccgctgattacgggcttcttgctgtccgcgattttagcggcgatcatgagttccatttcctcacagcttctcgtaacggcaagcgccattacggaagatttataccgcgcctttttcagacgggaagcgagcgataaagaattggtcatgaccggacgcctgtcggtattgatcgtggccgttatcgccatcctgctttccatgaatccgaacagcaccattcttgatctggtcggatatgcgtgggctggcttcggttcggctatcggccccgcgctcttgctcagtctgtactggaaacggatgaatgaatggggagcgcttgcggcgatgattaccggggccgcggccgttttaatctggattacgacagggcttgccgcttcaaccggcgtatacgaaatcattccggggttcttcctcagtctgattgccggtattgccgtcagcctgctgaccaaaaaaccggccgatgcttcttatcagctgttcagccggatggaagctcttttgaaaaacaagaaatagacaaaaagccgtcagattttatccctgacggcttttttcttccgcacttgtcctgctataaatactgtgagaaaatcatatcaatttattataagaaaaattgcggaggtgctgtgcaaattgagctggcctatcgaaccagacattttattaaagctgggcattgccacgctgatcggcatgatcatcggtcttgaacgcgaactgaaaaacaaaccgctcggactgaaaacctgtattgtcatcgccgtcagctcctgtatgctgacgatcgtcagcattaatgcagcatatcatttcccgaaatattaccgtatcatgatggatccgctccgccttcccgcccaaatcatttccggcgtcggttttatcggcgcgggcgtgatcctgcgtaaaagcaatgacgtcatatccggcctgacgacatcggctatcatctggggcgcggccgggctgggtctggctacaggcgccggcttttataaagaggcgttcgcaagcctcttgtttatcctgatcagtgtcgaatttcttccgtggctgatcagaaaaatcggtcccaatcgcttgaaggaaaaggatatccgcgtgagaatgtctctttccgataaagacaaaatgaccgagattttaaaggaaatgaaaagcaaacagctccgcattcactccgtccggattgatgacctgggtgaaaaagaatttccgattatggaagtgaaagtcagtgttcataaaaaccgctacaccactgacgtctattatgatattaaagaaattcagggcgtcgtcggagtaaaatgtgatacgttataaaaaacgccgggctggattcagccggcgtttttctatttatacgaatgcagaaaattgatactccgtaatcggtgtttcattttcgatatcgcgcctgaaggctttcagcatcccgagttcctcgtccccgagtgaattgaggtcaaacgcctgatgcaataatccgtagatcagcatatggcgcagccggaggaaatccgggatgtgttcaaaccatgcggaatcaaggtcattttcttccctgtagcctttcataaagtgagtcatgaattcacccgtaaacgcggccttgtcttcatacgggatgaccggataccacaacatgttgtacagcagaatactgatatcattcacaaaccaattgtagccgatatcatcaaaatcaaatgcagtgatttttccgttgtcccaattaaaattgccatgatgcagatcggcgtgcacaaggccgtagttttcaggattcttcggcaaacggcgcagtttttccattagagcatccgcccgctcaaatacgagatgctgatctgcgggcacgtattttctcagcttcagctgctcctcttcatcccattcctgccttttatatgccggatcgctcagacggtagcttttcgtcagccggtgcatgttccccgtgtactttccaagctggtaaaacagagttccgttccagtctgattcctccactttgcgtccgggcgctttttcatagactcttaataaaaacgctccgccttttccgtccggcacttcttcgacatctttgccatttaatgaaggaatcggctttgctactgaaagcccttcctttgccagatgatgaagccattccatttctccgagaatatattccggcgttcttctgatcgtatgcgtaatttttaagatatacggttcgttatctttcacaatttcatatacgtagttctctgcgtccgcaataaattgaaacttggtaaatccgtatatttcaccggcttcagccagcaccttatcttcctcaaaaatcgctttaatatctttatgcatgctgattcacccttttcataacatttgtaggcggtgtgtgtactcagcaaatgtcattcatcaacattcctgcccttcttttttcacagcagattcgtaacatccgcttagaaatgatatgtgttttcctgttaattcctaattatacaaatatcttaacatacctcattcctctctccaacgatattcacactaaaaaacccttgctcatacagaaatgaacaagggcatcttggttaatcgtaaatatggacggtcggttctttgtcacccgcattgcggacgatcagcgcttcctgcccgtcagacgaggtaatgttaatttcgacatcaactgagccttttgaataataatccatcagctcacctgttaagtattgggtgaaggcgatgacttcacttttcccgtaaaattgcatcgggatttcaatcttcatttttctcatttcatcgttttcgtacattgccgttccgacaactccggtgtaattcgggaagtagctgtcgatggcgtttttgaagcgtttaaacacttcggaatcatcagggtatttctttgccgtgtctgtatccgccggatagaagacgtacttttctttgacatcatcccagtttgaaatggtggatgagccggccttgacttctgttttcgcaatgtaattccccggtacgattgatgttttcggcgcttgtttataaagggcgacggtaatcggcacatttttcaggttatccattttccgaaggcggttaacgacttcctgtgcgatttcttcgccgtggctgcggatcgttttgtcgctgagctccacttcctgctgcggatcacctgtgttttcgcggtaatagtatacagagttgagagcgagaccgatcatgacaccgccaagctggatggaatttttatcttttcttactaagtaatcctgctcaagcatggacgctaagtaaatcgggctgttttcgtttttctcttttgctgatcccgagcttggcagcaccgggtttaagccgagattctggaaattggcgtctgcctttttcgcctttttcagatcactgccctcttttttgcggtcaagccagctgagaaccgtgtcctcatctaaatactggccttcctgatacaaatagtcatccgtcgggaacgtgtcttgagcgagccgcatcagcccagtctcgaattcatcgatgtccagcctcgtgttcagccggtccgcggtcaggccgcgcgcttttccggccttaaacgggagcaccattttatagtaggaatcagagatattatatttcggtatgatcgctttttcagaagactttgccgttttctgcgtgatctcttcctctttttttcccccgaaactcggcgaacaggccgacagcatgagtactgccgccgttgccgtcgccgccaatgccaacatctttttcaatagaaaacactcctcttatttctttagctctcccaatagctgtgcttcattccatacttcaatgtttaattcctgcgcttttgtcagcttgcttccggccgcttctccggcaatcagcaagtctgtttttttgctgacagatcccgtcagctttccgccgagcgcttcaatctgcgccttggcttcatttctggacagctcttcaagctttccggttaacacgatggttttgccggcaaaataagagtcgctgtcctctgcttttacttttttcgggcctttgtagagtgtgttcacaccgagttcctcaagttcattcaaaagctcaagcatttcctctttgcggaaataggtgataacggcatcggccatcttttcgccgatttcatctaccgcaagcagctcttcttccgtggcttgtttcagattttccaggctttcaaaatgcatggccagtgttttggccgcttttgagccgataaaacggatgccgagaccgaacagcaggcgttccagcgaattctctttcgacttttggatggagctgatcagattgtcagttgatttttcccccatccgctcaagccggatgacctgttctttcgtcagcttatacaaatcagcgacattacggacgagatgttcacggaaaagctgtgtgatgacacgttctccgagtccgtcaatattcatcgcgttgcgtgagacaaagtgaatcaggccttctctgatctgcgccggacattccggattgatgcagcgcagcgcgacttccccttcaatgcggacaagttcgctttcgcactcagggcagctggtcggcatattgaattctttttcttccccggtccgctgttcaattaagacattgacgacctcagggatgatgtcgcccgcttttttgacgaccactttatcgagaatgcggatatccttctctttaattaaatcttcgttatgaagggatgctcttgagaccgtcgttcccgcgacttttaccggttccagaacggcggtcggcgtaataacgcccgttcttccaacattcagttcgatatcgagcagttttgtcacgacctcttcagccgggaatttgtaagcaatcgcccagcgcgggctttttgccgtatacccgagttcttcctgctggtcgagcgaatcgactttgatgacgattccgtcaatttcataagggagatcggcccgcttcgcctgcagctcttcgatcatttcaatgacttcatctatcgtgtcgcattttttccgttcctggtttgttttaaaaccgagctcatccagaaaatccaggccctgactctgtgtttccacacccatctcgtcaagctccgctatactgtagacgaagatgtcaagatttcgtttcgctgcaattttcggatcgagctgtctgagtgagcccgcagccgcgttccggggattggcgaacggctcctcttcatgtttcagcctttcctcattgagcgcttcaaatgactgtttcggcatgtacgcctctccgcgcacttctatggaaagattacgtttcattttcagcggaatgttgcggatcgtttttaagttttcggtgatatcttcgcccgtcgttccgtctcctcttgtcgcgcctctgacgaaatagccgtcttcataacggagagaaacagcaagaccgtctattttcagctccacattgtaagcgacgccgtcaccgacagcctgacggacgcggcggtcaaaatcgcggagatcatcatcgttaaatgcgttgccgagactgagcatcggcgtgccgtgctgcaccttttgaaaagattcaagcaccgctcccccgacccgctgtgtgggcgaatcaggcgttctgagttccgggtgctcttcctctatggcaatcagctcctgcatcagtctgtcgtactcggaatccggcacgctcggttcatctaaggtgtaatattcataactgtactgatcgatggtgcggcgcaattcttctgcccggtgtttcgctgtttctttgtccatcatgttcttcctttcctcttcaggttactgcttttcaatcggcgcaaaagcggcaagcagacgcttcacgccgactgggctcgggaatgcgatatcaagctcggtgctttcgccttctccttttacgctgacaaccgttccggtgccccattttttatggcccgctttatcgccgaccgcccagctgagcgagtcgccgcctgttttgttcgcataggaaacgggacgggatacgggcccgcgtttcggctgcacttttcttcccggctgcatgcgaggtgttttcttctcatttaggttctccaataaatcgccaggtatttccctgataaagcgggattccggattcatattggtgcggccgaataaggttcgcattttggcattcgttaaatacagttcttcttccgccctcgtaatgcctacatatgcgagcctgcgttcttcttccatctcggcttcttccatcagggagcggctgtgcgggaacacgccttcttccatgcccattaagaacacgactggaaattcaagccccttagcggcgtgcagtgtcattaaagtgacggcatcctttccgcctgcttcttcttccttctggtcgagctggtcaatatccgcgatcagcgccagatcggtcagaaacgcgacgagagacttgtcttcgcttttttgttcgaagtttttcgtcacggaaagaaactcgtcgatattttcaaggcggctttgggcttcgattgatttttcggccttcagcatttctctgtattccgttttttcgagaatttcttccgtgagttccgtaatggacaggtaatcctgcatgttcgtcagattttcaatcatcgcgccaaagccgtcaagcgcgtttgccgctttcgcgctgacaccgatgaaatcaacctgtttgatcgcctggaacattgacattccgttcatcgccgcatatgaagcgattttttctagcgaagtggcgccgacgccacgcttcggcacattgacgatccgcgtaaaactgatgtcgtcgtccgggtttgacacaaggcgcaggtatgcaagaatgtctttaatttctttcctgtcgtagaacttggttccgccgacgatattgtagttcagaccggattttaaaagggtttcctcgatgacgcgcgactgggcgtttgtccggtataaaatcgcgatatcggaaagcttccgccggcccgagctgtgcagctcataaattttgcccgcgacgaattggccttcgccgaattcattgtcgccgctgtaataagaaagcttgatgccttcgtcattttccgtccacaggtttttcggcttgcggtttgagttgtttttgatcacttcgttagccgcctgcagaatccgctttgttgagcggtagttttgctcgagcagaatcacgtttgcgctcgggtaatctttttcaaaggaaaggatattcgcgatatccgccccgcgccatctgtaaatggactggtcggagtcaccgacgacgcagatattttcaagacgggccgcaagctgcttcacaaggaggtattgcgccctgttcgtatcctgatactcgtctacgtgaatgtactggaatttgcgctgataaaactcaagcacttccggcacacgctcaaaaagcttaatcgtcgtcatgattaaatcatcaaaatcgagcgattggtttttcagcagttttttctgataatcggtatacacgtcactcgtgacctgatcgtagtagccgccggccgtttttgcgaattcctcaggttcgatcagctcgtttttggcgctgctgatggagcctaaaatacttctcggatcaaactttttcggatcgatattccgctctttcaaaatccctttaataacggaaagctgatcagccgtatcaagaatggagaagtttcggttgatgccgattctgtcaatatccctgcgcagaatccgcacgcacatgctgtggaaggtggaaatccagatttcatccgcgccgggtccgagaatgctctccacccgctccttcatttctctggcggctttatttgtaaaggtaatcgccagaatgttccatggcgccacgtgtttttccgccattaagtatgcgattctgtgcgtcagcacacgtgtttttccgcttcccgcgcccgccatcagaagcagcggaccgtccgtcgtcttgaccgcttcctgctgaacgggatttaatccgcttaataattgattgctaatgtaattcatatccgttcaccgcctatcaaacatatgttctatcataaatcaatttcgtccgcttggctactttgtctttacagccgccaccgttttgagcgcctgatcaaaatcttcatatacggcatttccgacaacgatgacatcggcatgacggccgaaccgttccgccgtttccgcgtctttaatgccgcctccgtaaaacaggacggacttgtccagcacagccttcgttttctccaccgtttctatgtccgccagcatcccgctgtattccagataaaaaatcgggagatgaagcaaatgttccgcgacccgcgcataggcgagaatatcttctgtttctatatgtgtatccgcctccgtcaaagcggccgccttacaatcagggttgacgatgcagtagccctccgtcacgatttcctccattgacatgagctctccgtattctttcatcgcctgatgatgcatgccgacaatccagtccgcctttttgctgttgagcacactcggaatgaaataaagatcaaacccgggcacaatggaatcaatcgtcgacacctcaagtacgcacggcactaaaaaccgccgcacctttgacatcagtctcagcacattgtcctcggtgatattgtcgcttcctccgatcacaatggcgtcagtccctgattcacaaagccgttccagctgttcatccggtaaatctttattcggatcgagtttaaaaacatgcttccactcgttaacatcgtacatgcgttttcgttcctccattcgtttcttgccatttaaacattataacaaattcgtttggcccggaaaaacggaaaaagacgtcattcacctgattcacaaaaaaagattgcgctccgccggacgggaaacggctatgtttgaaaacagacaaaatgtggaatgtcaaagagaaaaaaggcaaggagtctgatctcaatggaacaagccattatcgtactgatttgtatattgatttttattattttagttcccgccgcattgtttctctggatttacataagagacgaaaagcaggaagaacattcagtgctgcgcaattatcccgcagcgggaaaactgcgctatatatttgaaaaaatcggacctgagctgcggcagtatttattcagcaatgataacgaagaacagccgttttcccggagagaatatgaacagacggtcatgtcgggaaagtataaaagcagaatgatgggcttcggctcagaacgggatttcgatcagccgggctattatatccgtaacgccctcttcccgaaacaaagggaggagctgcgcacagatcagacgccgaagatcgacacgatggtatacaagattgacaaagacaacctgctgaaacgcagcgaacaccgcgaaaaagcaaaagcggacccttattacctgcatccggacgatgtgcaagtgatcggccgcgacacatgcaagaaaccgttttatgtaaaagggttaatcggacaatcagcgatgagctacggctcacttggcgaccgggcaatcaccgccctgtcaaaagggctgcaccaggccggcggcacatggatgaatacaggcgaaggcggcctgtctgagtatcacttgaaaggcggcgcggatattatctgccaaatcggccccgggctgttcggcgtgcgcactgaagatggagaattttcatgggaagaatttaagaaaaaaagccgcctcgagcagattaaagcctttgaattaaagcttgcgcaaggggcgaaagctagaggcggtcatattgacggttcaaaggtgaccgaagaaattgccgccatcagaaatgtgcagcccggacaatccattgacagtccaaaccgcttcaacgagttctcaaatgttccggacatgcttgatttcattgagaaattaagaactgtcggtgaaaaaccggtcggcatcaaaattgtcccgggcagccgcaaagaccttgaagaccttatttcctgtatgagttcatcaggcaaacttcccgactttattacgattgacggcagtgaagggggaacgggagcttctttccatgagctggcggattccgtcggcctgccgattctgaccggcctccccttgttgacggccttttgaagacatacggtataagagataggctgaaaattttcgcatccggaaagctgctcactcccgataagattgccgttgccctcgcgttaggcgcggattttgtcaatattgcccggggaatgatgttttcagtcggctgtatccgcgctcaagtatgccacaccaatcattgtcctgtcggagtggcgacaaccgatccaaaacttcagcgcgcgctcagtatcgaggataaacagcatcgcgtctgcaactacgtgctctcgttgcgtgaagggctgtttcatcttgccgcggcggcgggtatcagctcgccgattcatttctcagctgaacacatcgtataccgggaggaagacggaagcctgagggaacttcccggccttttgaatcagcacgcataaaaaaaccgcctgccgtcatcggcagagcggttttttacgtagctgaggaggattctcctttgtttacgcggtcaagcgccatttcataggcgtcgttcccgtaatttaagcagcgcttcacccgggaaatcgtcgctgtggaagcacccgtttcgctttcaattttgtgatacgtatttccttcgcggagcattctcgccacttccaaacgctgcgccagcgattggatttcattaatcgtacaaagatcgtcaaagaaacgatagcattcctccagatctttcagcgataaaatagataaaaataactggtccagttcttttccgcgtaatttatcgatttgcatcgtcaaacaccttctcctttactaatggaagctgcatcgagatcaggcacgatattaatccatgtctttcctggcacaaacggaagaatctcaccgccttttacgggcagaatacggccgtctttatattcccagtctgactccataacatcgccgtgctgaagcaggaggcccttcccccctgactgaatatcgatggcccgccttccatctttgtctgtcatgcgatggccggcttcaacaataaaaatgttgtgcatggctaaaggctttccggtctcccggtctgtcgctttcacaccatcagagcttcttgtataagcatcagcttttttatcataatcgtattcgacaagatttgtaacgttttgtgttccataatctatccgaatattgtaggtttcgtttccgggttttgcatctgatgtctgaaatgggagcggttctgtttttccgttcagcttgtatcctttttgttccgccgccttcctgatattgtcatacgacgtgtaggaattgtggggcggcttgctgaaatcggctctccaaaacaggctgccgtcaaaatccaaaccgtttatataatcgtaagttccggactccagctgctttttagcgccgggactccagccatgatggacaaatatgctgttaaacccgctgctgagcgtgacaaaatattccctcgcgctccgcacaggcccgaccgtttccggcatctcactttgaaaaatcgcgagaaaccgcgtaatccggccctccgcgagcgcttcgatgacaacatccgcctttgacagcccggattggggcctcgccttcggatgattgttcactgcgactgcaatcggacggcgttctgcaagcttctgctcagttttcagccccgttaaaggagcttccgcttctttcggctgcacctgatcggcattgttctgccggcaggcggcaagcagcaaaaacgcaaaacaaagcatacaaacggttttccatcttttcatatgtcggctccctgcttttatattttaacgcattatcgatggaaagagtacagtttttttcatcacgtcgaatattcctctcggcgtaatgcggatataaggcaggtgtgtgctctgcaaaaagagcagcgtatagatcggatcgcagaatcggtagccccgctcctccagcagcgtcctcagtttttgctctttctcaagcacttcttcataattctccgcggatgcagaaccgtttaaagcgaggggaatctcatgaagaaccttcccgttttcggcaagcacgattccgccgccgatttctttcatccgtgagaaagcgagcaggatatcttctttattttttccggcagcgataatatctccggttgtcgtgtaggaactgacaaagccctgcacccgatcggcaaaacctttcagcattgtattgacccgccattttccatgcttatcgagaagcgtgagatagcattcatcatgatcaaaagaaagctggtcaacagaattatcaatcgcaatcatatacggctccataatgacggcgttgcgcattatcacacccatcggcattgaaaactgtaaatcatccatcgtcatatcatatgaaagctcaagagggacaagaccgccctttttccaatccgtttctgtaaacgcattcatatttcggccgtcttccctcagcaggatgcctttggagatcaccgtgaccgggtccggattcatcgggtcatcgagaatgttcaatgaagcaagccggcccggaccgatcacaccgagaaagtcatccatctgataatatttcgcgatattaaaggaggccatattgtaggcgtcaatcgccggaaccccttcctccaaagcgattttgattaattcattcgtcatgccgcctttataaaaatgcggcgtcgctccatccgtcgtgtaaaagaaatgatcataatgccggaagcctttttgatggagatcctgcaaaatcgttctcaaatcagggcggatggatgaatgtctgagcgaaacatagtaacccaattcaagccgtctcatcacctcgtcgccattcatcgcctcgtggtcagaatcagccccgaacagtttcatcttcgtcagtgttttttcagaagctccgggaaaatgcccttctatccgcttgcgcagtttctttgtcgcctgcatgcaatgaagcatcaagtcatcgccgtccatgaggcgcggccatccggtcaattctccgccttgaatgacatccggatgctcaatccattgcttgcggacatcaaaagaaaggagctggtcctcattcagcacttcagtctgcagatcatatctggaccaccagaaatattgcaccggctgtttttttagttcttccaatatagtaagcgctttctttttaccgctgtgcaaaagaaaaaacaagttatcattaacaaacgtcgttgttccgaattgagacacatattcggcgagcgtttggggattatatatttgaaaaggatgtgtatgcggttcaatgtaacctggcacaatgtattttccttcacaatttatggtatgaatgtgctctgctgcatcaggaagctcatgaccaacatatacaattcggtctccgtaaatccagacgttctttttcagccattgttttaaaaaaggatttaatacgagagcatcccgtaaaagtagcgttggaagcagctttgagtctacaacatccgcctgtgatctgatgtctttatttttccagttaaaggtacgttcggacattcacatactctccttcgcttatattagacccatcgtatcacatccgcacaattatcgcacggctaaaacgttacaaattattgaagatgaatgaaaaactttttctaagggagctgaaatgatgaaaccgaatatcagtttattaaacgccgttatgcgcatcacttgcggcctcaccattttgtctgccgcttcagcaaaatacacgagaaaaccttggtgcaagatgcatctcttctgtatgatgatgggcgcgatgaaagcggcgtccggcatcctccgcttctgtccggtgacatatatgttccaagccggaatgaatcaggatgacagccatcagcaagaaaaataacaagccgtttcggcttgttatttttttctcctgtcccgcgagtatgagaagaatctgccggcgatcccggcatcacaaaagccgggacagaattcaagactgcatgacaatcttagtcgtcattcagaagaaaacccgcatcttttaagacgcgggggtttcctctttatcgctgcgatgctttcagcgcacgggcgccgatatcgcttctgtaaaacagtccgggttttgtcagccccgaaacggcgctgtacactttatccctcgccgcttcaaatgtctcagcaaatgccgtgacattggcgacccggccgccgttcgtaacaaattgtccgccgtcttttttcgttccggcatgaaaaacggcgatcccgtcttcagcggacgtcaaactgccgatcggcgtccctttcgcatagccttccggatagccttcagaagccaggacaacgctgaccgcggccgtatccttccatcttaggtcaacatctttctcatgcagaagatctaagagcacctgaatgaggtccgattccattctcggcacgacggcctgtgtttccggatctccgaagcgcgcgttgaattcaatgacctttgatccgtcttccgtcagaatcagccccgcgtacagcacgcccgtgaaggagcgcccctctttcaccattgcttttgccgccggcttcacaatcgtttcgactgcgcttctgacgatatcatcggaaatgtgcggcaccggtgagtaggctcccattccgcccgtattcggccctttgtctccatcgaaggcgcgtttatgatcttgagcgatgaccatcggatagacggtctccccttttacaaacgccattaaagaaaattcttcgccggcgagaaactcttcaatgacaacagatgcgctcgcctccccgaatttctcatcctcaagaaaatcgtgcaggcattcaatcgcttcttcttccgtcatcgcgactgtgacaccttttccggcggcaagcccgtccgctttaatgacaatcggcgcgcctttttgctgtacatatgctttcgcctcttcaaatgaagtaaacgtctcgtactccgccgtcggaatgccgtattttttcattaaatccttggcaaactgtttgcttccttcaataatagccgctttttcagacggtccgaaaacaagcagtccggctttttcaaactcgtcggctatcccttcaatcagaggaacttcggggccgataatcgtcaggccgacatgatgttctttcgcaaacgcaatgagtgcggcatgatcgctttctccaatgttgaccagcgtcgcgcagtctgtcataccgtcatttccgggcgcggcgtacaccgtgtcaacaagcgggctttgcgccgctttccaagccaatgtatgctctctgccgccttttccgataatcaatacattcacgcttcgttccccccttaatgtttgaaatgtctgatgccggtgaataccatggcgattccgtattcatccgctttcttaatcgaatcttcatcgcggaccgatccgccgggctggataatcgccgtgacaccggcttttgcggcttcttcgactgtatccggcatcgggaaaaacgcgtctgatccgagcgcgctgccttttgctttttctccggcctgctcaatggcgattttggctgaaccgacgcgattcatctgtcctgcgcccacaccgaccgtcatatggtcttttgcaaggacgatcgcgttggatttcacatgtttgacgactttccaggccagcttcaaatcttcccattcctgctcgctcggctctctttttgtcgggatggtgatgtcggcgtcatcaaatccatggacgtctaaatcttgaatcaaaagaccgccctgtacggaagtcagctgtttttctttctttcctgatgcggtcacgtcaagcgtgagcagacgaaggtttttcttcgccgtcagcacgttcagcgcttcttcactgaaagaaggggcgataatgatttctaaaaagatgccgtgaagggcttcagccgttgcctgatcaacttcacggttcagcgcgatgatgccgccgaaaatggaggttttatcagcttcatacgctttattgaatgcttcctcaattgaagctcccgtaccgactccgcatggattcatatgtttaacggcaacagctgcgggttctgtaaattcccggacgatttgaacagccgcatccgcgtccttaatattgttataagaaagctctttgccgtgaagctgttttgccgctgcgatggaaccggagacaggaagtgcgctttggtagaaaaccgcctcttggtgagggttttcaccgtagcggagcgactgttttttctcaaaagtaacagtgaattgctcagggtctttctcaccggcctcgcgtgttaagtaatcagcgattaatgcgtcgtatgccgcggtatggcggaatactttggccgcaagctcgcgttttcttttgagcgaaacgccgccgtgttctttcatctcattgagcacggagctgtaatcggccggatctgtgatgaccgtcacatcctgatggtttttcgatgcggcgcgcagcatgccgggaccgccgatatcaatgttttctatcgcttcatcgtatgttacgtcttcttttgaaatcgtttctttaaacggataaaggttgacgaccacaaggtcaatcggtgcaatgccgtgttcattgatctgcgccatatgctctttattgtctcttacggcaagcagaccgccgtgaatattaggatggagtgtttttaaccgtccgtccataatttcaggaaatccggtcacttctgaaatgccgatgacatccacaccgttttcctgaagaagtttttttgttcctccggtcgaaatgacttcgacgccgagctctgtcagttcctttacgaaaggtacgagatttgttttatcagaaacactgattagtgcgcgtttgattgtcatgccttttcacctctgttatttagtcccagcagccgtttcacaacgctcggataccatttgtgctcaagctcgtgtattgtatgctctatgtcttcaagcgtatcgttttcctgtatttcgaatgctttttgcgcgataatcggtccggtgtccatgccttcgtcgacgtaatgaacggtaatgcccgccactttcacaccggcccgatacgcctgtccgacagcgtcaatcccagggaatgccggaagaagcgagggatgtatattaataatgcgtcctccgtatgcttcaagcagcgtatctccaatcagtctcatatagccggcgagaacgattaattccgccccgtgcaggcgcagctgttcaataatggcccgttcaaaggccgctttgttttcaaaagatgacggttcaaaggcgaatgacgggatatgtaaagcctccgccctttccgccgcctttgcctgaggcttatccgtcacgagaagcgagagctccgcatcccacttctcttctctcatgcgtttggcaatggcctcgaagttcgatccgtttcctgaagcaaataccgcaaactttttcatgaaagagccgcaccgccgaaagaaatgccttcgccccgcttgacccggccgatcagataagccttctcgccctgagcttcaagcgtgccgatgacgtctgtcaggttttcttctttaacggcaaggacaaaaccgatgcccatattaaagacattgaacatttcttcttctttcagcttgccgtgctcctgcagaaacggaaaaatcggcgggatcggccatgatccgtgatcaatttccgcgctcaatccgtccggcagcatccgcgggatattctcgatgaatcctccgcctgtcacatgcgccatgccgtccaccttaccgcttttcaccgccttgagcaccggcttcacatatattctcgtcggttccagcaattcttcgccgagaggacgcgcaaacggttcatagacagtatccaaatcaagtccgccgtcatcaagaagcacttttctcaccagggaaaatccgttgctgtgaaggccgcttgaagtaagtccgattaagagatgcccctcttcgatatgttcaccggtgacgatttcgtctttttccgcgacgccgactgaaaagcccgcaatatcgtattcatcagacgtatacagccccggcatttccgccgtctcaccgccgataagcgctgatcctgactgctcgcatccgtccgccacaccctgaacgatctgctcaattttcaccggatcagccttgccgaccgccaaataatcaaggaaaaacagcggctccgctccctgggcaagcacatcgtttacacacatcgcgaccgcatcgacgccgatcgtgtcatgcttatccattgaaaatgcgagtttcagtttggtgccgacaccgtctgttccggaaattaaaacaggcttttgatacggaagctctgacagatcaaacattccgccaaaaccgcccaggcttcccataacgccgagccttttcgtgcgctccacgtgttttttcattcgtttgacggcttcgtatccggcttcgatgtcaactccggcatttttataagcatcagacatccctatcactccttgtcaattcgtttctcctaaaaaggcagaaagagaaaggcagcctgaattcccgctgcctttatgtcattttcacattttattttgtcagcaccgcttcttttacgtgaggaagcactgtatcctgataaatttccgtcggatatttgcccgtaaaacaagcgaggcattgtccgcaattggtgtcttcaaattttcggccgactccttttaacaatccgtctacacttaagaaagaaagcgtgtcggcaccgatgatctgacggatttcttccacggaatgagaagaagcgatcagctcctcatgggttgatgtgtcgataccgtagaagcacggatgagcgatcggcggtgaactgatcttgacgtgcacctctgtcgcccccgcttctctgagcattgtgacaatccggcggcttgtcgtcccgcgcacgatggaatcatcaaccatgacgacccgttttccttcgacaacaccgcggacggcggacagcttcattctgacgccttgctcacggagagcctgtgacggctggataaacgttctgccgacataacggtttttaatgagaccgagttcatacgggatgcccgtcgcctcggcatagccgatggccgcagaaatactggaatcaggcacgcctgtgacgacatccgcttcaaccgcggactcccgggcaagcattttcccgaggtttttccgggcgctgtgcacgttaatgccgtcgatattgctgtcaggtcttgagaaataaatgtactccatgctgcagatggaacggttgatattcatggaaaaacgctctgatttcaagccttcatcgttgatgatcagcatttcgcccggctctacctcacgaaggtacgttgcgccgacaacatcaaatgcgcacgtttctgaagcgaccacataagcatcgcccatgatgccgattgacagcggtctgagtccgttcgggtcaagcgctacgatcatctctgtttcagtcatgattaaaaaggcataagcgcctttcagcatagatagcgaatttttgatttgatccttcagcgaaaagtgtccgctgcgtttaatcagatgagccagcacttccgtatcggaggaagtctgaaaaatgctcccttggttttcaagctgctgcttcagctgtgtggcgttgaccaggtttccgttatgggcgagcgcgaggctgccgttgttttgcgaacggaacaggagcggctgaacattttcatatccgcctcctccagccgttgcgtaacgaacatgcccgatcgcgccttttccctttactttgctgagctcgccgttttgaaatacttcagtgatcagcccttggcctttgtgcgccgtcagtttttcgccgtcagtcgcgacaattcccgcgccttcctgtcctctgtgctggaggctgtggagaccgtaatacgtaatttgcggggcttcttcatgtccccagatgccaaacacaccgcattcttcattcaggcctttgatttcagcaagcatggaatagctcctttccacgcgcgctcaagttctttcgtttgcgcgtgaaccaattgttgtccgtcctggttttgaatcgccagaagtccgtcagccgttacctcaccgatatgaaccgcatcagccgcagccgcttcaaacgccgcttggtgttcttttttgaccgaaacgacgaagcgggattgagattcagagaataataatgccgcttccccttcaacagtcacgttggcgccaaggttttccgtcgtcatgacactttctgcaatcgctacgcctaagccgccttcagatacgtcatgcgcggattgaacgaagccttttttaatcgcgtcaagcaatgctttttggcgtgacagctctatatcaagatcgatttgcggcgctttgccgtaaatgcggccttctgtcattttttgcagttcgcttccggcaaactcaggttttgtttcgccgatcacgtatacaagatcccccgcttgtttgaaatgctgtgtcgtaatatgagcggtatcttcaattaagccgaccatgccgataacaggcgtcgggtagatagccgttccgttcgattcattataaagtgatacgttaccgccgatgacgggtgtgctgagaacattgcacgcctcgctgatgccgtcggccgctttttcgatctgccagaaaatttcaggtttttccgggtttccgaaattcagattatccgtgaccgcaagcggttcggcgccggagcatacgatgttgcgcgccgcttcggcaacggcgatttttccgccttcttctggatcaagatataaataacgggcgttgcaatccgtcgtcatcgccagcgcttttttcgtgccgcggattctgagcactcccgcgtcagagcccggagcgaccaccgtatttgtgcgcaccatgtagtcatattgatcatacacccactctttgctggcaattgtcggctgctgcagcagggcaaaaagcgtctctgtcccatcttttacttcaggcgcgggaacttctgtttcctgaaactcgcggtagtacgcgggttctgctgacggtttgtggtatacaggcgcttcttccgccagtgcgtcgaccggaagttcgcaaacaacctctccgttatggcggaggcggagcattttatcatccgtcacatgacctacggaaaccgcttcaaggtcatatttatcaaaaatatcgacaatttcctgttcacgtccgcgttcaatgacgagaagcatgcgttcctgagactcggaaagcatcatttcgtaagcggtcatacccgtttcccgctgcggaatgagatcaaggttcatttcaatgccggagccggctttgcttgccatttcagcactcgaacttgtcagaccggccgcccccatatcctgaatgccgactaaggcgtcgcattggatgacttcaaggcatgcttccaggagaagtttttccatgaaaggatcgccgacctgcaccgcggaacgtttttcttcagatgaatctgacatttcttctgatgcgaaagtagcgccgtgtatgccgtcgcggcccgttttagcgccgacgtacatgaccgtgttgccgacacctttcgcctggccttttttaatatctttatgatcaatcaagccgacgcacattgcattgacaagcggattgccctcatagcttgcgtcaaactgcacttctccgccgaccgtcgggatgccgatacagtttccgtatcccgcgattcccgccactacttcttcaaacaagtacttcacacgaggtgaagtgagttcaccaaatcgaagagagtttaatacagctatcggacgggcgcccattgagaaaacgtcacggataatgccgcccactcccgtcgcagcaccttggtatggctcaagcgctgacgggtggttatgagattcaattttgaacacgaccgcctgattgtcaccgatgtcaacgattcccgcgccttctccgggaccctgcagcacgcgttcgccgctagtcgggaatttgcgtaaaaccggttttgagtttttatagctgcagtgctctgaccacatcacggaaaaaatcccgatttccgtgtagttcggcaatcttccgataatagattcaatgagtgcgaactcgtcatcactgacacccatttgctgatagagtttctcttcttttatttgttctttacttggttcaagcagtagcgacatgagtttccctccaatttttcacgatagaccggaacaatgtaagaccgtctgcgctgccgagcagttcatcgactgcgcgctcagggtgaggcatcatgcctaatacgttgcctttctcattcacgacgccggcaatgccgctgacgcttccgttaatatcgccgccgtatgtgaagacgatttgattgttttcttttaatctttcaagcgtttcgtcatcacagtagaaattgccttcgccgtgggcaaccggaatcgtaatcgattgtcctttttcataggaagatgtgaataacgtatcgccgttctgtacgattaattcaaccgggcggcagatgaactttaaatctttgttgcgtctcatggcgccgggcagaagtccgagctcctgcagaatctggaatccgttgcagacgccgagaaccggttttccttcggcagccgcttttttcacggccggcatgatgtttgcgaatctggcgatggcgccgcatctcaagtagtcgccgtatgaaaacccgccggggatgagcacgccgtcaaatccgtcaaggcttgtttcctcgtgccagacatactcgacttcttcgccgagttcgtcctttacggcgtgaaacatatcaatatcacagttggagccgggtaacacaatcaccgcaaatttcactgtgcgacaacctcctcaacttcatatcggtagtcttcaatgactgtattggcaaggagcttttcacacatttctttcacgagcgcgtcaagatcgcggtcagatttttcgatcgtcagctccatgtattttccgatgcgcacatcctgcacttcattgtaggtcatgctgtgcaatgcatgctgcactgcgcttccttgaggatcgagcacactttcttttaagctgacataaactttcactttatacattatgaaatgcctcccagtcttttgaaaatctcttcgtatgcgtcggttaagctccccaggttccgtctgaacaaatctttatcgagcttttcgtttgtgtctttgtcccacagacggcacgtgtcaggagaaatttcatccgctaaaagcacccgtccctctgcgtctaagccgaattccagcttaaaatctattaatctgaccccgcagtcttcaaaaatatgctgaagttcttgattcacctggtttgtaatcgatttgatcgtttcgacatgctcaggagccgccgcttttaagagccggatatgatcttctgtgatgagcggatcgccgagtgcgtcatccttgtagtaaaattcgataatcggctgcgggagctctgttccttccgggatgccgagacgtttcgacatgcttccggcggcaatgtttctgaccacgacttcaagcggaatgatgctcacttttttgatgagctgctctgattctgaaacacgctccacaaagtggttgtcaattcctttggcgtgcagatgtttgaaaatcaggcttgaaatttcattgttcagacggccctttccgctgatctccgcttttttctcaccgttaaaggctgttgcggaatccttgtagaccacgcggagaatctgttcgtcttcagtttgataaattcgcttcgcttttccttcataaagaagattattgttcacaatattcacggaaggcctcctaacccgaatgttgggaatattcaatctacggcggctgaagaagccgcctccggctggcttcttctataaacctaaacgctcaaagatcaagtcgacgtttttcagatgataattgtagtcaaagcaatcggcaatctgttccggtgtgaggcgggacgtgattttttcctccgcttcgacaagctggcggaacggcacttgtttttcccacgcttccatcgctttcggctgaaccgtgtcatatgcttcttcacgaggcagacccgtgtcgattaaagcaagcagcacgcgctgagaatagattaaaccgagtgtgcggtccatgttgcgtttcatattttccgggaataccgttaagtttttgacgatgttgctgaatcggttcagcatgtaattcagcgcgattgtcgcgtcaggaagaatgatgcgctcagctgatgaatgagaaatatcacgctcatgccataacggtacattttcgtatgccgtcagcatgtacccgcggatcacgcgcgccatgcccgtcatattttccgacccgatcggattccgtttatgaggcatagccgatgagcctttttgtcctttagcaaaaaactcttccacttcacgtgtttcactcttttggagaccgcggatttccactgcgaatttttcaatgctcgtcgcgatcaaagccagtgccgccatgtaatccgcatgacggtcgcgctgtaatgtctgagtggaaatcggcgccgctttcagcccgagtttttcacagacatactgctctacgaacggatcaatatttgcatatgtgccgaccgcgccggaaagcttgccgacttcgatcccttcttttgcctgcttgaaacgttcaaggttgcgtttcatttcttcgtgccaaagcgcgagcttcaggccgaaagtcgtcggttccgcgtgtacgccgtgcgtgcggcccatcatgaccgtgtatttatgttctttcgctttttcttttataatgtcaacaaatctctcaatgtccttgagcaagatctcattcgcctgttttaatagataggaaagagcggtatccacgacatctgttgacgtcaggccgtagtggacccattttctttcttcgcctaatgattctgaaaccgcgcgggtaaatgcaacgacgtcatggcgcgtatcctgctcgatttccaaaatccggttgatgtcaaaagacgcgttttcgcgcatgaccttgacgtcttctttcggaatgacgccaagctcagcccaggcttcacaggctaaaatctcgacttccagccatgcctggtatctgttttcgtccgtccagatcgcggacatttcaggtcttgaataacgttcgatcattatgctcgtcctccgtctcttttcatccatatgttcgtgatgtcctgaatccatgtttcatcaggcttccgcaaaaatgtcatatgccccattttgcgcccttttttaatctcatgttttccgtacaggtacagtttggcttcttttaaaagctccgtatgctcctccgcaagcttcacttcctcaccgagcagattcaccatcattcccggtttgagaagatcggttctgccgagaggaagtccgcagaccgctctgatgtgctgttcgaattggctcgtttcacaaaggtcgagcgtataatgcccggagttgtgaggacgcggcgccagttcattgatcaaaaggtctccgtcttctgtgacgaacatttccaccgcaagcggcccgacaagctccaatttctccgcgagctggacggcaagcgcctctgcccgcttttgaaccgtttcctccgctctcgcgggcacgatgctttggaacagaatattatttttgtggatattttcagcagccggaaaggttgaaatctcaccgtgcaccgatctcgtcacgataacggaaagctccatccggaacgatacccagctttccagtatgcacgtgccgttttctagcagcgcggccgcttcgtctgtctgtccttcttccttaatgacaaattggcctttgccgtcatatccgccgcggcatgttttcagcaccgccgggagccccagtgcctgaacagcttcctcaagctcccgtccgctgtttacgatccgataaggagcgacttgacagcctgctgactggatcgcctttttttccgtttccctgttttgggtgataagcagcagctcgcttccctggggaagatatgcatgttctttgagccagttgagcgcctcgtaatcgatattttcaaattcgtacgtaatgatgtcactgactccggccaatttttgaatcgcttcacggtcattgtactgggcggtaatctcaatatcggcgatctgtccgcatggcgagtctttcacgggatcgacgactgcgactttatagcccatctgttttgcggcgacagccatcatttttccgagctgtccgcctccgataatgccgatgacggcgccgggataaatcgtttttttatcagacaagctgatcactgctttccagcaccgtttgttttgtcgcatttcttctcgcctctagtttatccgcaatgtcaccgtcaaatgccgacaaaatctgcgcggctaacagacccgcgttcactgcgcccgcttttccgatcgccgttgtcgcgaccggcacgccgccgggcatctgtacgatagacagaagagaatcaagcccgttaagcgattttgtctgaaccggtacgccgatcaccggcagtgtcgttttggccgccgtcatacccggcagatgcgccgctccaccggctccggcaataatgacttttaagcctctgtctctggcgctttctgcatattcaaacatcaaatcaggcgtccgatgcgcggatactacctgtttttcataaggaatgtgaagttcgtcaagtatgtcgcatgcatgtttcattgtctcccaatcggaggtgcttcccatgatgattcctgctagcggctgcattctgttcccaccttctcatgctttgtttttcagaaaaaaaagcccggcttatattgcaactatgaggaagcaatacaaaccgggcatggcgcgcgtatcgtcagtcgttcgcttctgcgatatccatgtcagctgtttatcactttcctgcatagtccggccgtttacggcagccgggtagaaacttatgggccatattcccaagattatatgaggtcgtgttttgatttcatgtttatcttaacaacggacttggataatgtcaacgacattatcgaacgatataaaaattctttcttttaatgttcgtgtttagatcaatttcccttcaaatacgatttttttcccgcaaggaacgacttgaattgatccattttctttcttttctgtaaagatcggctcttccatccgccggacgggcatataaccctcttccttcattaaagtgagaatggtgtcaatcgtttcatgttccgttacttcaaaccgtttcttttttggctttgtcattccttaattctcctcttcttcactgctttcacccagaatccgccgtggatcgttttcggctcaaaggcgatgataaacgctttttcatcaagcgttttaatcgtatcatacagctgaagctcatatttgcgcggcgtcagaatctgcatggcggtccggtctccttcaagtccgcccgcaacccagcttgtaacaccgtatcctttttcccggagctgtttcggcaggtccagatcgagctccttcgtaatgacgttgactgttatgtagccgagcgccagtttttcttcaattttcattcccactatgacgccgaggccgtagccgagcgcataggcaatgacgttttgaatttgattcagattgtcgagcacaagactcaggccggtcacatacacaaggatttcaattgtactgatgcctgcggcgaaatagcgctgtccctttaatgtcagaatcatcctgatcgtaaagaaagagacatatataatgttaatgatgagaataatgagaaccatacctatactgttggataaaattgtctgcatcactgattcccctcctctgactttgaaaagccaatctttcaattaaggatagtttaccctcttttcatcattttcaaaagaaaaaaaagcccgccccgcaaggcagactctcaagctcttatcagtgaagctcggcttttttcaatcgtttgacggcttcatattccttctcaagttcactcagcgtgtacccggacagttcctgaacatggtcttgataaaaccctgagcggatcagttttgtcctcaggtgctgttttttccgattaatggcttctcgcaacaacggggccatcttcatcatccctttccgaatcataaagagtagtgccgctttcgaattgctgttgctctcatcatatctcggccgggtcctcaaaacaacacgcttcattagaaaaatttgtaaacattgtgaaagacaaatttcgacttataaaggaatcagcgaagcagtaaagtactcggaaatgagcggccatgtcacagccgtaaaaacgagcatgatgatgaccgccgcggaaatacagtacatcacgtcagccgcaggcttttcagccgatttgtatagaatctgcacaaactgcaccatcgccgaggcggccagaaacaaggtcagcgccgtaaacaccacggtgatgaccggcagattcaatatcgcgaaaatcatccacacgatagagcaggcgacagccggaaccaaaagcgatccgacccccgcggccgcatcccgcatcgtaattttctgcttcatcatataacgtgatacaagccagaccgcgccggccgcagcggcaaaaaagacgagcgtatacacgagaacgacggtaaagccgtcaaaaaacgtatgatgccgctccccgtatccgagaggcctttgctggcttgccctcagctgaaaccaatttccgattgagaaaaagatactgaatacaagcattgaaataagagcatatttaaagcgggaaaagccgtcttccccaacgaccttcaccggtgatgtcaaaatgcgcagcgcgaaacggcaataacgtttgaccgcggcccatgcagaagcgagtttttccgtaaaagccggagccgggcgccgttccttttcttttttcttttgcttttgataacgtcccgcatttctggacattctcgacagcggttcttcatcagttccctgatgctgtttttcttcttccaacgtttcttttctttcttccgtcatgtcagcaactcctatcaaaaaaatacggcggaatttgtttagcaagaaaataaaacacttatataaggtaccgaagcggccttaaacagtcaagcggttttcttcacccggacacccacatgacgttttatattatgtattggttttacggaataggacaaaaacaaaaaaccggctttccccagccggtttttccgttatttcaagaagatgaaatacaggataaagatgacgaacagcccgtacataatcgggtgaacgctttttccttttcctttgcagatcattgtaatcgggtagaaaataaaaccgatcgcaatccccgtcgcaatactgtacgtcagcggcatcataatcatcgttaaaaatgccggaacagccacctcgaatttatcccaggcgatcttaccgagcggcgccaccatcagcgcgccgacgataattaaagccggagccgtcacattcgtggtgacaactgacagaagcggcgagaaaaacatcgccagcaaaaagagaatgcccgtcacaacagccgcgaagccggagcgcgcccccgccgcaacgcctgagctggattcaacataagaagtcgttgtagacgtaccgagcacggctccgataacgattgatgttgaatccgccaaaagcgctcttcccgcacgcggaagtttgttttccttcatcagcccggcctgtgtcgctacagctaccagcgtaccggccgtatcgaaaaatccgacgaacaggaaagttaaaatgacaatcagcatttgtacggagaagatatccggaaggtgcatccacgcctgtccgaaagtcggcgcaagactcggcacgctgccgacaatgtgtgtcggaaccggaatcagcccgcagatcataccggcaaccgccgtcaaaagcattccgataaacacgccgccgtttacgcgaagcaccatcagaatgaccgtcacaataacaccgaaaaccgtcagcagcacagggccgctgtgaatattgccgatagacaccaaagtcgatgagttcgcttcaataatgcccgaaccctgcaaaccgacaaatgtgataaacaaaccgatacccgcgccgaccgccaatttcagctcaggcggaatcgcattaatgattttttcccgcaatcccgtcagtgaaagcgccacgaagataattccggaaatcaagacgccggaaagcgcagcctgccatgaaatccccatgccgagtacgacagagaaggcaaaaaacgcatttaatcccatacccggcgcaatcgcgatcggatactttgcaataagccccattaaaatacagccggccgcagatgccaaggctgtagcggtgaacaccgcgccctgatcaatttttaatgcttcgggaaatcctttcacaccgtttaaagacaatgtcagcggattgacgaacagaatgtacgccattgacaaaaaggtcgttaaaccgccgatgatttcattacgatagcttgtccccagctcatcaaactgaaaaaattgcttcaagccaattgcctccttcattctctcccatttattctgcccgttatccgccaaataaaaaacgccccaaatacatttgggacgcttgactacatacgttcagtctgaataaataagaatggattatttatatcaaacgattgagattgatccgtagtcaagccatttacggtagcttggtagaaacttgcgggccatatccccgccattatacgatatctgcatatttgatttctgagtctattgtatcaattcaattttgaaaactcaataaaaaaacgaacaatccagttaaaaaaaattggtttattcgttaattgaccaaaaatggaagacggcaagggccgccttcccggcatcattttccgttcgcaggccgaaccggcaccgcgaatgtgatccccttgtcatccgccagcaagttcataaccgtttgattgacgtacaaagcatatgaatcgaatgagaaatcgcgcaatgaatagtctttatcggatgaatcatctaattcaaaaacggattccatttcaccctttttaagattcgtgactttcgccttattccctttcagataatagcctttttcatactcattaagcgatggccaagttttcatttttttcgtattgccgagaccgattgattcaccgacattcatcagctgatctttatccgctttgctgtaattaattcctgtgaattgataatcgacgatcacccgtctgtcttgctgtttgatctttttgatggtaatgccgacatgatgatgtttcgttttataactgacgggcagttttgttttcagaggcacgatttctcccggctctgattctgtttttatatcacccgttatgaaaagtgttttcgctttcgggtctatcggtttgctgaattgagtttggccgcgtattcttttcccgccgccgggaagattcttcctgccgccaagttcaatattcgacatcgtcatttcataatggtttccagcatcatccgttgcttcgtcaatcgagatggcatcatttttggctgcatcatagaagtcgatagaatacaggagagccgatcccatcgttccgttttccgcccggatatcgaaaaagcggtataatccgtgatttacattcacagctttcgttccttcaagagaaacggacttttgttttttaatagggagtgtaaagcgccagtttccggggatatccttgatttgtgtaatgacaagcggaagcttatcaccgtctttcagctttgagccgtccgtgaacaggcgaagctgccccgcgtaccgcccgtctttcatttttttcatatcactgctgtcataatcctctgctaacatattccgtggatctttataatcgacttgaaaagagatgctctcctcatctgatttcaaattatcaacgataaagttataaacgagctgtccgctgtcgtaatacacacttttcactgtcaccgtgattccgcgtgattccgctttttcgttcagttttgtcaccaaattgcttttaaacagcgcagaacctgccttatcctgaaacagactgtaaatttgtccggcaacaggaatgtttcccatagcggtgttaacggagggcatgaacaagcctgaggacagatacagaataaacagagcagcagcaaccgcgaggccgtttatcacttttcgtccccatctccgtctgacggcgccttcttttccggcacggacagcagcgctgtgtatcacgtttttcaactcagctttcggcacgtcaatgtcctgatacaattgcttcatttgatgcttttccatatgtgtttatcctccttttccagttcctgcttcaatgcttttctcgccctgtagagatgcgtttttacagtgccttccgccataccggtctgttcagcgatcataccaatcgagaaatcttgaaaataataaagctgaatggtcagctgtatatgttcgtcaagcgtttccagagcattccgaagatctatgtattcttcaatattcttattctccgcgcgcgtatcgtgctgcggctcaaacggaatgacgtctccgtgctttttcctcatcgcaaaaatcgtatgaagcagaatccggatcagccacgttttaaaatatttcggctccttcagctgtgcgatatgaagaaaagccttgtaagccgtttcctgaacagcgtccagtgtatcttccttgtgatgcaaataaagataagctgttttatataaagtctcctgatgggttgtgatcagtttttcaaaggctgcggcatcaccttttttcgcctttttgatcaatcgttcttccttcaccttatccacctcctatgctgttagatatgaatcggggcaaaacggtttcaaaaagatgaaaaaaaacgcctcttttttaaaagagacgttttttatcttcatttattcccactcaatcgttgcaggcggcttgctcgtaatgtcatacacgacgcggttgatgtgtttcacttcgttgacgatccgtgttgaaatcacttcaagcacatcccaagggatacgcgcccagtcagatgtcatgccgtcaattgatgttacggcacggataccgattgtgtaatcatacgttctcgcatctcccatgacgccgacgctgcggatgtcaggaagaaccgtgaagtactgccagatgtcgcgctcaaggccgtggttcgccacttcttcacgcagaatcgcgtctgattcacgaacgatttcaagtttttcttccgttacttcaccgagtacgcggatgccaagtccagggcccgggaacggctgacgccatacgatatcatccggaaggccgagctctgtgccaagcgcgcgcacttcgtctttgaaaagggtgttcagcggctcgatcagttcaaactgcatatcttcaggaagtccgccgacattgtgatgcgatttgatcgtttgcgccgttgcagtaccgctctcgataatatccgtgtaaagcgttccttgcgcaaggtaatcgatgcctttcagcttgtccgcttcatcatcaaatacgtaaatgaattcgttgccgatgattttgcgtttttgctcaggatcagaaacacctttcagcttgtttaagaatctgtctttcgcatcaactttaatgacattcatattaaagccttcgctgaacgttttcatgacgccttcagcttcgcctttacgaagcaggccgtgatcgacgaaaatacaagtcagctggtcgccgatcgctttatgaattaaagcagccacaacagaggaatcaacaccgccgcttagcgcgcaaagaacctgcttgtctccgactgtttcgcggattttttgcatttcgatttcgataaagttttccattgaccattcgcctttacattcacaaggcccgaagacaaagtttttcagaaggtcatttccgtattctgaatgacggacttccggatggaactgcacaccgtaccattttttgtcttttttgctcatcgccgagttcgggcagtgatggctcgtcgcgtctaccgtaaatccttccggcacttgtacgactaagtcgccgtggctcatccagacaacttgttcttccggaagatccttgaacaagtctggagttccttgaatctgaatgttcgcttttccgtattcgcgctggcttgccgcctcgactttccctccgaggtaatgagtcatcagctgcatgccgtagcagatgcccaatacaggaatatcgagttcaaagattttttcatcacagcggaaagatccttcatcatatacactgttcggtccgcctgaaaggataattccttttggattcatttctttgatttcctcagctgtcaacgtatggggatgcagctcgctatatacgccaaattcacggatccggcgggtaatcagctggttatactgactgccgaaatcaagaacaagaatcatttcattcactaacttcgtcatggttgtcacctaatctcctctaagtttttgacacagaaaaaacggaggacacacgttcagccctctgtcggcaagacttgtccggaagcccggctttttaacgctcccgggctcccatttaacattcatatattctaacaacaggacgatatgcggtcaagactatcttcttttaattatattttcccacaactgtcccgattcattccaaagctttgcggcattatcgctgcggtataaagcacgctcatagcgcagcgtcagctcggacatgtcgtttgtatggtgcgcctcatcaacccttgcggcaaaatcgcggagcgtttctccgtctcccctgctgaacccttttcgtttcagctggcggagcagcgcggcatatgcgtcgaaaaagacgtcttcatccgttcgccgcttcaatccggctgctgtaacgtgcggaatccagcgcacccggaacagccaggcgagtgccgccgcggctgaaattacgatgacgatggctgcatacggccacaggtgtgccgcggttttgttgcggatcacaggctgcggtgccgcgctgtgatcccgctttttcggtgtttcttctttttccggctttgtttcctgacgctgcttgtcagacggtgaatccgaattccccgctgagcctccgctgtcttttgccgcggtatgattttgctctgacgtaaactccgtcggattggtgaagccttttgtcggctcaaacgtcacccagccctgatcgggaaaatacacttctacccacgaatgggcgttgttgtttgtgacttcataaatgtggccgttatggtcgcctgcccctttatattcaccggatgtatagcccttcacccagcgggcgggaattcccgcagagcggagcagcacggccattgccgatgaaaagttatcacaatatcctcttttcgtttcaaacagaaattgatcgacataatcctgattgtgctccggaaccgcgacatcctgtgtattatacgaaaatgcggaagatccgagataatcctcgatcgccttcgctttatcgaacatattatgatgatcccgcgtcaatctgtccgcaagctgtcgcactcttcccggaaggctgtcggggacctgtaaataccggtcattgaattgattctgctcacggtatcgtttcactttcacttttctgagatcattcagcttaaagacgggcgcctgaaaagtcaccgtgtaccgtcccatattgcggatgttgcccacttgttcactgaccggcgtaatttgctcggtgtttccgttcatttcaagctgaatcgagtgcttcggtttaatattggagacgccgatcggatacatgacgtgattatagagataattctcatcaatggacacctgtgccgtataccgtctcgtctgcacactccggtcaaaccatatatcttccacattgccgccgttcagtttataggacatgccctgatcggtctccacccagcctttccccgtgtatgtatctttcgtttccacccggaagtacgcccgttcttttcccttccatgtaaaaaccggcgtatcatcctcctgaaaaggaccgcccaatgtttcatcatgattgccgtagccgattttactttcggcggcgggcacttctttgtggtttgtgattttttttagaaacggcacgggatccggccagttcgggtctgatttcggagccgccagaccgaacactacggaagcgcagataaacagcatcagcggcagaaaccatttgagtatcaatctttttttaaacgctatgtgttccgtaagccggatgcgctccatatacaaaagccccatcatcaaaaagccgataaagacgatccggatgacggcgtacgcggcatcataaggagtaaacgtatcaagcacggtgatatacgccaccgtcatgataaaaaagaataatattttccgctgatagatcacccagtaatgcagcaaatacacgagcagccataaaagcacaaaaaacagcaacgtgcggaatgacggattcatatcattccatcttccggttccgatgtggcgggcattttgcatcacgtcccgcaaaaaagaaacgagccattccggctgaaaaatagaacctttataaaacaggatgtgaatactgatcaacgtaaacagaatgcaggacggcacggtcacgtaccacctcatccggaagaatgacagcagaaatgccaaaccgataaaaacgatgaaaaaaccggtatgttttgtatccgtaaaattgtgcagcggcctgagccattcccataacaataaaaaagcgagaaaataaaacagcagcagactcagcctgcttccctggttctcgtcatgcggcatggcgcgccacctctctttctaaacaacatgggacacccgtttgtccctgatcatttgcaccttaatatttttctgagcgaagatgagagcgagtttccgttctttctccgaaagcgcggcattcgtttctttcgccaaaaacaccgtcatgtcagcacggccgggctcagcctgtttgagaaggtcttctgtaagactgcccgtcacgacggcaatggaagctttacccagttctttccctaaacgcccgcctgcatcggcttcttccgactctgaagctgatgccaggtaacgcagcatctgtctgaaatgccgctctccctcccggacgggaaatacagtccggtcgctccccaatgaaataaatcctgcgggagagcccttcacaagcgccgtgtaaagcagggatgccgaagctgacaccgcggcttcaaacgaaggggacggcctgcagtccaaaaggagaatcatattcatactctgcaacgggtcaaattccttcgtcatcagctcatttcgacgcgccgatgttttccagtcaagtgcggaaaaccggtcgcccggctgataatttctgacgctcgcagccattgctgtgcggtgtacctgaaacggagcgccggcacccgcaccctcttctccggatgcagcctgcggcttatagtgaacaggcccgtacgccgggaaaaccagaaccgtatccgttacggaaaacgacgccgtcttgtccaaaagcccgagaacatctcccgtccgaactctgatcgtatgtaaatgatgctctccgcgcggcacctgcggcagctcatattgtaacgtcatcttcctttgaaaccacggaaacacaagctgtttcgcactgcgcctctcaccaagcgtttccggcatcacatcttcaatgaccatatatgtcagcggaaacggcaggcgcctcgtcagcctgatggtggcagacagcctgtcgcctgaggttaactgggcggaggacacgtcacgcgtcacctgaaacgcccgcaacgggtacacagcgaccagcccggcgtaaacggtaaacggcaaaaacgcataaaataaaaaccagctcacaaatccgccctgaaacatggcataagaaaagacagccgccgtcagtacggccaacataagcagcttccagccatatagaagccaatgcatcttctttctcattagcggaccgacatcctttgaacgggaactttttccgtttgcatgatgtcttctataaccgcttccggcgtcacatcgttaaatttcgcctcggcggtcaagatcattctgtgcggcagcgtatacggagccaaatactggacgtcatcaggaatgacgtaatcgcggtcatgaagcagcgcgtacgcctgcgcggctttcattattgaaattgaaccgcgcgggctgacgcccagatgtacggacggatgccggcgggtatgctgagtaatgccgacgatatacgctttaactccatcatccacccgcacctgctccagtttttgctggagggtgatgaactgttctttagaaatgacgggctcgattgtttcaagcggattgcgcccttcctgcaaagacagaacccgaagctcctcctcggcagtcgggtagcccatgcgcagcttaaataaaaaccggtcaagctgggcttcgggaagcggatacgttccttcatattcaaccgggttttgtgtggccatgacgaaaaacggctcagccagccgcattgtctttccgtcaatcgtgacattcccttcctccatcgcctcaagcagggaagactgagttttcggagaggttctgttaatttcatcagccagcacgatattccccatgatcggtcccgggcggtattcaaattccattgttttcgtattataaatagagacacccgtcacatctgacggcagaagatccggcgtgaactgaatcctcttaaagtcagctccgatcagcttggccaaagcccggaccatcatcgtttttccgactcccggcacgtcttccagcagcacatgcccttttgcgagaatggcggccagactgagtatggcgatatcccgttttcctatgatgatgttttcaatatgctcaacggctttctccagcagcggatgcagctcttctttataagccattcttctcctcctagtcatctctcaaatttcaattatcgtaacctaactttaccacaaaatataaacagtataaaaaaacgtttccagcgaattgtttccagtccgaaaaaggaaaaaagctccctttagaaaggaagctttatttcagctggagaggctccatatgaacgtgtgaatggtcaatggcatgttcctctttcatcccggcgccttctgctgtacgaatgcgaaaaaaatgtcatattttcttacatcattttcaactgtctgtggcatttatgatagaataatacttgtctgaatattcagcataaacaaaccaaaaggaggcaaagaatgaatcagcctaactctttatctaagggattaaaaacccggcatatgaccatgatttcaattgccggcgtgatcggcgccggattatttgtcggaagcggatcagtcattcattccaccggacccggagcgattgtctcctacgctttagcaggattattagtgatttttattatgagaatgctgggggaaatgtcctccgtcaacccgacaagcggttcgttttcacagtacgcgcatgacgccatcggtccttgggccggttttacgatcggatggctgtattggtttttctgggtcatcgtcattgccattgaagccattgcaggcgccggaatcatacagtactggttcccgggcattccgttatggctgacgagtctgcttctgaccgtgctgttaacactgacgaatatttattcagttaaatcgttcggcgaatttgaatactggctttccttagtgaaggtagcgacgatcgttgtcttcttaatcgcgggatttgcgttcattttcggaatcgttcccggcagcaagccggtcgggctggaaaatttggcgggcagcggcggatttttccctaaaggtccaagttccgttctgctcggcatcgtcgttgtcattttttctttcatgggatctgaaatcgtcgcaatcgcagcgggagaaacgtcaaatccggtcgaatccgtcacaaaggcgacccgctcagtcgtttggcggatcattattttttacgtcggctccattgcggttgtggtcacactgctgccatgggattcagccaatattttggaaagccccttcgttgccgttttgagccatatcggggttcccgcagccgctcaaatcatgaatttcatcgtcctgacagccgttctgtcctgcctgaactccgggctttatacgacgtcacggatgctgtattcactggcagagcgaaatgaagcgccgcggcgttttatgaaactgagtaaaagaggcgtaccggttcaagccattatcgccggcacctttttttcctacattgccgttgttatgaactacttttctccagactccgtatttttgttcctggtcaattcatcaggggcgatcgcactgctcgtctatctcgtcatcgccgtctcacatctgagaatgagaaagaaaatcgaacggacaaaccctgaatctcttaaaatcaaaatgtggttctatccgtacttaacctacctgacgatcatcgccatttgcgccatcttgttatctatgctgtttatcagttcaatgcggtctgaatttctgctgacaggatttattactctgctggtacttgcctcatatgtattccgcaaaaaacaaaaaccgaaagagagcgcttccgaaagccgggttgcgcaataaccgcaaacacccccctcaaaaaagggcgggtgtttttttaaccaacctgttccaggcagcattaactgtagtacaggatttcaataaatgataaggacaggatgaaaaatggcactagaaaaatttgcagatgaactgccgattatcgaaacactccagccgcagaagaaatcagacggcagcacgtattacgaagtcaccatgaaggaatgctttcacaagctgcaccgcgatctcccgccgacccggctttgggggtataacggtttgtttcccggcccgacgatcgacgtgaacaaagatgaaaacgtctatattaaatggatgaatgacctgccggataagcattttctgcccgtggatcataccattcaccattcagaaagcggccatcaggaacccgatgtcaaaaccgtcgtccatttacacggaggagcaacgccgccggacagcgacggctacccagaagcctggttcacaaaggattttaaggaaacgggtccttattttgagaaagaggtataccattatccaaacaaacagcgcggggctctgttatggtatcacgatcacgccatggcgattacgaggctcaatgtgtacgccgggcttgccgggatgtatatcatccgcgagcgaaaagaaaagcagctgaagcttccctccggagagtacgacgtaccgcttatgattttggaccgcacgttaaatgacgacggttccttgtcttatccaagcggacctgctaatccttccgaaacgctgcccgacccttccatcgtcccgtttttttgcggaaataccattctcgtcaatggtaaagcgtggccgtatatggaagttgaaccgcggacatatcgtttccgcatccttaatgcctccaatacgagaacattttctctctcgctcaataacggcgggaagtttatccaaatcggttctgacggcggactgcttccccgctctgtcaaaacacaatctatcagcttagccccggccgagcggtatgatgtgctcatcgatttctccgcctttgacggagaacatatcattttaacgaacggcaccggctgcgggggcgacgtcgatccggatacagacgccaatgtgatgcaattccgcgtcacaaaaccgctgaagggagaagacacaagccggaagcctaaatatctttcaacaatgcctaatgtaacatcaaaaagaatacacaacatcaggacactgaaactcacaaatacgcaagacaaatacggccggcccgttttgacgctgaataacaagcgatggcatgatcctgtgacagaagcgccgaagctcggcgcaacggaaatctggtcgattatcaatccgatggggggaacccatccgatacacctgcaccttgtttccttccaaatccttgaccggcgtccctttgacttagagcgttataacaaattcggcgacattgtgtatacaggccccgccgtcccgcctcctccaagtgaaaaaggctggaaagacaccgtgcaggcgcactcgggggaagtcatcagaatcgcggcgactttcgctccttacagcggacgctacgtatggcactgtcatattttagagcacgaagattacgacatgatgagaccgatggacgtcacggataagcagtaaacaaacatcccccctttctccagaaggggctttttttatttatccaaaaagaaaaaataagaaggcgcttttttgcatatactgtaataacaggaagacgatgcaccctcattggaaatctggatagaaaaaggaattaggagattagggaaaagtatgagacaatgaaggagtgcacgaaaattcataagggaagaagtgactttatgtcttactacaacaaacgtaatcaggaaccgctgcctaaagaagatgtcagtacgtgggaatgcacaaaagaggactgtatcggctggagcagaaagaattttgccggcagtgataccccgacttgccccctttgcggcagtaaaatgatcgacggcgtccgttcgttggtaaatctccaaaacaataatcaaacggcatcaagttagacctcccttttacgagtctcaacatagagaaggcctccatgtctcatgagaggcctttgcgttatcatgtccttttatgatgcaaaggagcaatgaacatgaaaaacgatcggcagcagaaagatctgaaggaaatggcaaaacggcggaaaatgaaccttgccgcacagtcattcatcgaaacgcttcattttgccgttccgattctccgttttttcaaatggctcgcctcagccgcagccagctttgttcatgaaaaaacacccagcgggcgctgagtgtttttttcatgattggatgacggaaaaactattgataatgccgtggtcattttcccagactttttcgcattttttcgtatccaaatgataagcataaatggtccggaccttcgcattccgccccgtttcatccttcagacgcttagcgccttttgcttccgccatgaaataaatgatgctgccgtctttagaaaactgaggctgggcatcaatcagcggagcgaagtccttcccgtttgagataatcgttttatcttttttcgttttgacattcatcagacggatggacgctttttgttccgtccctttttgtgtataagatgtaaagacaaggttctttccgtccggtgacaccgccacgccgctgataaactgttcaaggtttgtcaggtcctgaaggtgttcgccagctcctgctgcaaaccggatattcgtcggttcagggtcaatccccttctcatttgcctcatccgttttttgataatcctctttgacggaataatgcagaagcgcaaaatcgttttggctgcggttataaaagaagctgcttacactgtcgtctttctcatcggcggcaggatacagattttcataacgtttcgttttcaaatcaaaagatgcgagacggaaaatatcttcatccgcttttccgagacggaaataaatgtgcgtcagatcctttgataaaaacagactgtcagcgcttgccgttcctttataaagcaccgtcttctttttcgtcttcagatcaagcttatacagacgcatctcattttcgtcattattcccgacaaaatagagcacctgatgggcgtcatccagcgcaaacgccggatatgccgaaagcttttcctcgtacagcacgcggccgtcctcgtaatatttcgtcatcagatctttgtctgtaatggaaacaagcagcttgtcatggccgccggagacaacggcttttccgccgccgtcgctttttcctttgatcagtaaaacggacgcgatgaccgccgccgccaaaacggcggcaagcaacatccagatccatcgtttcttcttcattatcaatctctccgtcaatcagaaaaagcaagaatcagagtccttgctttttaagatggtctattttaatagctgtagtgtccggatactcttcctttgcttaacggatatccgagcgctttgaacgctttcgggctgacatccaatacggcattcggcagacggcctacatcatttttatatactgtgataaccttttttggttttgctttcgcataagctctgattttcgttccgtttctcggaacgtcaaatcctaattttgtcgcgcaatcccagtgtcccagttttttaccggaagatccttttttaccgactccattataccatgtaatatttccgttcacttttttagcacttgcatcagaagagaaactgatcgctcccagcgtgcttcctgctaaaatcaataaggctaagaataacttcttcaagctttcgtcctcctgattctttattctaggcaaaattatacaccaagaagacgattataatatttcaatcactttacatgttcattacaacgtgatgagacatgcacataacgacggcacaattacctgttctatataattccatggtaaattatactacaaaatttaattcattagcgttataatattcatagagtatttctgcattcaatatggactttttataaggcctattgatagttgcataatatgatatattttgagaaatcaggctttaggaagcactttattccttttaaccgtggttcatattgatcatgtacctatactcgtttcaatcagactaggagtgataatcaatgaaagcggcaagatggcacaatcaaaaagacattcgaatcgaaaacattgatgaacctaaagcagaaccgggtaaagtcaaaattaaagtcaaatggtgcgggatttgcggaagcgaccttcatgaatatttgggaggcccgatctttattccggtcggcgaacctcatccgttaacaaacgaaatggcgcccgtcacgatgggtcacgaattctcaggagaagtcgtggaagtgggcgaaggcgtcaaaaattacagcgtcggcgaccgtgtcgtcgtggaaccgatttttgccacacacggacatcagggagcctataaccttgatgaacaaatgggattcttaggcttagccggaggcggcggcggattttctgaatatgtatccgttgacgaagaattgctgtttaagcttcctgaagagctttcttacgaacagggcgcgcttgttgagccgtcagcggtagcgctttacgccgtccgccaaagcaaattaaaagcgggcgacaaggcggcagtttttggctgcggaccgatcgggctgcttgtgattgaagccctgaaagcggccggcgccacagatatttacgcggttgaactttcaccggaacgtcaggaaaaagcgaaagaactcggcgctatcatcattgatccgtcaaaaacggacgatgtcgttgaagaaatcgctaaacgcacaaacggcggcgttgatgtttcttatgaagtaacgggcgttcctgtcgttctccgccaggcgatccagtcaacaaacattgccggtgaaacggttatcgtcagcatctgggaaaaaggagcggaaattcatccgaacgatatcgtcatcaaagaacggaccgtaaaagggattatcggataccgtgacatcttcccttccgttcttgcactgatgaaagagggctacttctcagcagataagctcgtcacgaaaaaaatcgtgctcgacgatctgattgaagaaggcttcggcgctttaatcaaagagaaaaaccaagtgaaaatcttagtcaaaccgaactaaaccgttcagctgaatatcagacacatccgaaaaagagccgttccggctctttttttcatctcatcgtctttccttccttttccttttaaaaatgatcccctctgcgcaaactatttttcaccctgtcccgtctatccttaggcagcagcctatgatacgtattttttaaaaaggagccctttgaagcaatgaagaacgaaacagccaaagcgtcgcttgtgacgtgcataactgagcgcaaggaagacttttaccggcttgcgtacagttacgtaaaaaacaaggatgacgcgttagatattgttcaggaatcaattcaaaaagcgctgacatcggtcgaatccgtcaaaaaccccgatgtgatcaaaagctggttttataaaattttagtgcgcacggccattgattttctccgcaaacagaaaaaactgaaagtgatggatgatgaaacgatcgagtttttaagccgaggaaaggaagatcactacaaggacacagaccttcacgaagcgcttgatgacctgccgcatcaatataaaaccattatcattctgcgtttctttgaagacctgaaattagaagaaatcgcggacatcacgggggaaaacatcaacaccgtcaaaacacgcctttacagggggctgaagctcatgcgcattcagctgacgaaggaggatctttcttaatggaaaagagattagaacaattaagagaagagtataaaagtgtgcccattcctaaggaactggacagcattgtcgaaaaagcccttcagcaaaaaccgaagaaaaaacgaatcgtgatgtggccgacatccgcggcagtcgctgcggccgtcttatttaccgccgttgtcaatatcaacccggatgccgcacaagccatgtctaaaatccccgtcatcggcaaagtcgtccaagccatcacattcacggagatgaaggaagaaaagaaccaatcaagcattgatgtgaaaacgcccgctctgtccggactttccgatcataaactcgaagacagcatcaaccggcattatatgaaagaaagcaaagagctgtatcaggaatttatgaaggcgacctcaaaaagcaaaaaaggccacctcagtatttacagcgattatgaaaccgttactgacacagcggatctgatctcaatccgccgtgatatcgaaaaaacgcaagcttcatcttatacgcaaagccgttacatcacgattgataaaaagaatgaggccgtgcttacgttaaagagtttatttaaagatgaccgttatattaaagtcatcagcgaaaatattaaagaacaaatgaaaaaacagatgaaagaagatccgaataaaatatactgggtcgaagaagatgatatgacggagccttttaaagccatccgcgccgaccagaatttttatattacagataagcacaaacttgttatttcatttgatgaatacgaagcggcacccggatatatgggcgttacagagtttacaataccgacctccgtcatctccaagctgcttgtcggagaccgctacatcagataaagaaagaaaaaaatccatgatatccgcagatcatggattttttctttcgtcccgcaacagccaagatgcataagggacccttttcatataacagacgccggactgggactgaaaagtttaagaaaatcacagcatttcatacattttttctgaaacaaaatccccttccgaatgcgtctaattaacggaacaaatggaagactgtacagaaatcagctatagctatccgcaaaacagcgagaatttccgcacacattattggaggaataccatgtcagacaagtcactgcatcaccgctatattcccggactggatggacttcgcgcctttgccgtcctcgcagttatcgcatatcatctgaattttaactgggccgacggcggtttcattggtgttgatatcttttttgttttatcggggtatttaattacatctattatattgcctgtccaaggcaatgccatcacccttgatttgcgtgatttttgggtgcgccggatcagacggcttctgccggcggcttatctgatgattatcatgacggtcatttgggtcgtattgtttaacagcgagctcctgcataccgtacgcggagatgcggtctcctcacttttttacataagcaattggtggtttatctttcatcaactttcttatttcgacagcttcggctccccttcgccattaaaaaacctttggtcgctggcgattgaagaacagttttatatcatatggcccttcctgctgcttgcgggaatgtacatatgtaaaacacgggcccggcttgcggccgcggtcatgttcctcgcgttatgttcggcagtcgtaatgagtatgatgtatgtgcccggcggagatccgagccgcgtttattacgggacggatacccggtcatttgaattgctgatcggctgcgctttagctttagtgtggccgatgaaacgattatcttccaaacggctgccgagcagcatgaaacacctgcttcacgggacggagcttgccgcttttgccgcgctgctgctttgcgtcttttacacggatgaatatgaacccttcctgtacaagggcggcatgcttttgatcagcatcaccgcagcggttcttgtcgcatgtttatgccatccgagcagctttttgggacatgtcctttcatggaagccgcttcgctggatcggaacgagatcatacggaatctacctttggcattacccggttttcgtactgagcacacccgtgcaggaaatcggaaatccggtttattggcactgcgccgtcagaatcggcgccactttcattcttgccgagctatcttaccatttcattgaacagccgatccgcactgcgggcttccggccatttttacgccgcgtgtttctgaaccgctttctggaatggaagacgtcctctgtcatcagcagaatgtcgctcggcctcattcttgccgccattctcgtatttgcgggcgggctgtcagggatagccgaagagaaaaaacagccgcaatggacgtacgcgcagaatgatcagcaagaaaccgccgcctcttcgcacaaaacggccgatcacgatcagcctgcaaaagaagaagacagcaagaaaaaacacggcggcgaaaaaacggataccgcgtcagacaaaaacaagaaagaaccagcagacaaatcagatacgaagaaaaacgacgagaaaaaggaacggtcatctcaaaaaacggctgatccaaaacaaacacagcctcagcaagacgtgctggccatcggtgactcggtgatgctggacattgcgtcatacctgcggcagtccctccctcatgtcaccatcgacggaaaggtaggaagacaagtctctcaagcactccagctcacttcggaatatgcgtcatttaatcagccgaacaaagcggtcatcatcgagttagggacgaatggctatttcacaaacagccaaattgaatcactgatcagctccttttcaaaagccgatatctatcttgtcaacacgcgtgtaccgcggcagtgggaaagcaaagtaaacgaatcattgcgccggcaggccgagtcacgcaaaaatgtgacgcttgtcgattggcacgcaaaagcattgcagcaccctgaatacttcacaccggacggcgtccatctcatacctgagggatcaaaagcgctgacatccctcatcgttcaaacaatgaaatcatgacaaaaaaagaggccccaaaaaggcctctttttcgtatatcatcaggcaagtttctgtccgcaattcgggcaaaaattcgcgccttccgttttcgttccgcagttcggacagaatttcggcttagccgctccttccgagccgtttgcctgttcggtcccctgattctgctgactttgattttgctgcggctggttctgctgattttgattcatttggttcatcatttgatttgccacattcattcccatcatcatgcccgccatgtctgaggcggcgccgcttccgctcattttgccggatgacatgccgtccgtcatggaaatctgctgatagcggttcacatcgcccaccatgccgtaagaagcgtttttcgtaatcatatcctgaacttcctgcggatagttaaagctcataatattgaagcccgtaatcgacatgccgtctccgatcagctgcatatcaagatcttcttgaatcccttttccgatttcaaatgaattcgactgcagattgaacatgtcttttccttctctggtgatccatttcatcaaaagctgatcgagaatagacgtaatccggattttaatgtcctctactaaatagctgtctctgacacccgcaatcttatcaatcaatccgatgtagtcaatgaccttgaagttaaatgtgccgtttgcgcggatcggcataccgcccggcatacctgccgccggaatgttgatggcgttttttgtgccccacttcacggtgaactccttcgtattcacaaacagcacttccgcccgcatgccgctgttaaagccaaacttaaacccttttagtgtcgatagaaacggaatgatttctgattcgatatcataatcgccgtcatcacggaaaatcccttcaatcttcccgttgtataaaaagatggcatcctgtcccggccggatgatcagacggctgccttttttaatttcacggttgttccatttatagaaaaccatgtcgtctctgaattcttcccattccaccacatttgctaactgatttctgaaaaaacccatgtatgctcaaatcctttacatataatttaaaaacttcccttgcttccgctgtaactcgtgccgcccctcgtgactccgccgtcattgtcattatctttatctggctttttttctcttgtaatgtcggttcggatatatgtgtcgtgctggctcagcacttcagacgtatcgtgatccatatacgtgctgccggtgacggtgaccttgccgccggaattgtacaccatcacggtgacggcgattccggccgctgctgcagcgataatcagctgaaaccaccatgtgagcagcagattgtcagacctgtcgtccgggcttttccccatatctttataagccatcttgatgtaagtctgaaacgccttttcataatggcctgcggaaatatctgacgagatcgtatttctgatcgtattcagccggctgctgttcaaatacgtctccgcctttttatatccggagagaaatacttcccgatccttcatatcaatagtcaatatcgccgtgcttccgctaaaatgactgtcataaaaatcaccggcatactgttcgatctccttaccgcccgttccgtttgcggtaagaatgataaaatcggtatggcgcttttctcccagcttcccggccaattcctcaagtttcttcgtttcatccttcgttaataaatgagcattgtcataaacatattgcttctgttccgcggcagacgccgatgtatgtaaagaaaaagacagcatcagaaaaaggacgaagcagaagagacacgctttttttatcgatactttcatcaaaaaccgcctcctatcataagtgagacgagtcttaatgctaaaaacgcaccggcggttatgccgccgaaccacgcggccacttttccggcactgatcggcggtttgccgacaaccttgcccgtctgcccgttcatcgcaaaaatgtgctcagcccgctcatagtcgtagctgaccatccagaccggaagcagtacgtaaaagctgctgattttatcggtctgaatctgctcatccgtaatgtcagccgtcgtatacccggagaaggtggatctgatataagaatcaatataatggctgattttatccttcgcccgcggaaagagatcgtcatcggtataattgtacttttccgctatatatcccgctaaataggccgtattaaactccttcagctcactgtatgagtaaggctccaatttgtccattaattcatcattcattttttctgaagcgtcgaccggaattttgagataatcaagattgatatcgcggtacgcgttgtaatactcggtctccgtcacccggtattctccatcttcatagtgatgcactctcgtacaaacggcattgacctgaaccttgctgtttaagtcaaacatccaaaacggcacgtacatgccggttatgctcttcacccgatcggcagtcataaatcctttcggtgtcagacggccgtttcggcaccactttttaaaagcgctcatggcttcttctttactgatcgtaaaaggaatcaccatcgaaggcgcgagatttcccgataatcggtcggcgagaacggcggctcctccgcaaaacccgcacgtcgtggccgtcgtttccgcctcagtcattaataccgcgccgcagttctcacagcggtactcgttcgcctcattttcggaaaatctcgttgttatatactcttttggcaggctttcaatctgatcctgccgcccgcagctgtgacatgtcagcatgccggatgaactgtcaaagaccatatcatcgccgcagttcgggcatttataagaaatgatcattctgtttctctcactttctctttatatcggacaaagctgcagcccgctgtctattgatctttactgaaaagcattttctgcttaagcgccgccaactcatcgtcgacactgctttgattgctgtcatatttagccgtcagctcgtcaatatcgtctttcggagacgcgttgagctcagccatcgcattggcgtgatcaagcgcccggttgaccttgtcttccattctgccgaaagctgtcagcgattggcccgcatttgacacagaggaccccaatttgttcattctctcctgcgtttttgccacagaccacttcgctttgatggcatttcttcgcgactcaagctctccgatatcagcgacaagcttgtcatgcattttgcgcatttgagacgcgttggaagaagcgagctgataagccgtttgcagctcagtcagtcttgattcaacagccgttttcctttccaaaaatgtccgcgcatcggcttcattgccggcctgcaacgctttcatcgcgtaactttccatcttttcggcatcagcctggcattctgttaatgctcttttcgcccgctgttcctcagccatgacagaagccgtctccgctttcacttttcctaaatcactgttcagattccgtaaatattgatcaaccattttttcagggttttcagctttatccagcagcgcattgatattgcttgacataatgtctttaaatcttcctaaaatactcatttttcattttcctcccaaaattaaatagtaacaagttcacagttatatatactgtttttttcgaaaaaggtttcattttctcttgaatttatgtatttttatatgaaaatagtctcattcagcccatttgtgccggcggaaattcttcacgagcagatacagtgagaacaaagaataaacaaacagcccgatcatcaacccgctcactaacggataatgcttcgccgcatacacaaagaaatccagctgcgaaatctgttccggacttgtaatcgtatccgtcccattcaaaagctttgagaatttagccgtatcattccaatcaaacgagtcagaaacaagctcactcccctgataccaattgacagcggcgagacaaagaaaacaaaaaacagaaaacgcgcattgcacaataagaaaaacatgtttcataaaaaaattcctccgcggttcaatatcacaggccgtcacactgtacatgacggcagcagcagaaacttggttttactcagaactgataaaaacattattgtatgtacttcacagcggttcaatttactggatgcctttctaaagtataccgtatatcgaaaagggtttcagacctaaataaagaggatgcttcccgaagtccgatgactttcaagaaacatcctccatactttacagtgatacttcaacctcttttaagctcggcaaagcatcaatcgcaccgattttggtgcacacgagcgcccccgctttattggcaaatgagacaatatcacgcagcttcgcaaaatcttcggctgccgtctgaacctcatccgtgcgcgccagctgatacagcgccgcgccgacaaacgcatcgcccgctcccgttgagtctattgatgtcaccggaatgctcggaatgatgtcaatatccttcccatttgaaagaagggtcccgcttttccctagtgtcaccgccacaataccggccccaagctcatgaagaaccgcaacgccttctttatgatccttcgcaccgctgatgatctcaagctcttcgtcactgactttcacaaaatcacttacggcaatggctttttttgcggtgtttataaactctgaaactcttcctttccataaatcctcacggtagttaggatcgaaggaaataaactgtccattgtctttcgcaatcgacatcagccgtaaataggccgagcaaaacggatcagataacaatgccgtcgctgatccgaaatgaaggattttcgcatcgtttaccttttccagatcaatatcatcaagcgtaaacaaagcgtccgctcctctgttaaacacaaagtcgcgctccccgttttgttttaatgaaacaaacgcaagcgttgtaggcgctttctcatccatgacgagcatagacgtatcgacatgtacggcgtccaatgtctgcttcagaaagtacccgaacggatctttgcctgttttcccgctgaaagccgcgtctccgcccagcttagcaatggctgccgacacattcgccggtgcgccgccggcactttttaagaaattgcgcccttccgtcaaatcaacatccacatcggtacaaaagaaatcaattaacaattctccaatacaaataacagattgccttcccacattatcacactcatttatcaattctcgattatagtttcagtatagtgctttctgtcataaatacaaccgtttacatagaatattttaaattttacgtatacttatctggcagccctttgctccagatcagacatcatctgctgatattttttttcagttaaaggataaaaagaaataagaataatagacagcagaatgaacaatcccggaatgagcgcattcatatttttaatcgcattcaatgacgaggcggtctgatcggtattcgcggcatatccggcgattccgagataaacggccgaaaatgaccccgctaacgcaactccgagcttattgatgaaactcatgctcgaaatcaccacgccatcagcccggactccggttttccattccgcataatcgacacaatcggcaaccattccccaagcaagcgtatttaaaggcgtcgtgaaaaatcccgaaacgaaaagccaaaagaaaataaggggaatcgaggaatacgatgtaaactgaaggcccgcataagaaatcagcgataacgccgccgtgatgatcatgacctgcttccggccccgcttcttagaaaagaaaggaataaacagattgctgatcagcgctgcgccgaaaaacagcacggttcctaaaaacacaaattccttatggctgacgttatacgtaaaatagtacaccatcgtgctgagcttaatgttaaacccgatcgcaaaagctaaaaatgaagaaaccaaaatgagcaaaggcttgtttcggaacaaaacagacaacgtctttttcattccttgtttttttcttttttcaggctgaatccgttcccgcacggtaaagaagctgaacagattcaatgcgatgctcaccgccgcatagataagcgccgtcatctggaatccgaacgcctgatctttcccgccgatggcgtccgcaagcggtgtcgcacaggaaatcgataacagaattccgatataaaccaaaatcatccgggtcgtcgtcagaaccgtccgttcctccacagaattcgtcatccgacccgttaagctgttgaccggaatcgtctgcatgctgaaggacatcccaagcagaatataagtgatgtacgcataaaccatgttccctgtctcgccgaaatgaggagtcgtaaagcataagaacgtaaataacgcaaaaggaaacgccacccacaaaagatacggccttgcctttccccatcttgtattcgtcttgtctagaatcacgcccataatcgggtcaaaaatagcgtccagcacccttacgataagaaacaaagctgcgatgaccgcaggcttaatgccgccgacatctgtatagtagaataataagtatgcgtttacaaactgaaagataatattgtacgacatatcgccgaatccgtagccgatccgttccatccaggacaggccgcgatgtttcgtctttactgccgatgctttttctgtttcaatcatcatttcccaccccaagaatccgttttcatttttgataagcaagagggagaatgcaaagatcctccccgttcactcagcgatttggatacaccatcacttttaggcattcatttttgtattgaaaggcgcgttccatcgcctcttgcgtcttctccagcggatattggtccgttacaagatgcttcgtgtccactatgccggaagcgagaaattcaattcccttcggatacgtattcgcataacggaagattccgtatatatcaatctcgttatctgcaataaacggcacattgagcggaatctcgttctgagaaggcaaaccgacaatcgccagttttccgccccggcgcacggaagccagtgcggattgcaatgctgccggattccccgctgtttcccaggcagcatcaacgcctctgccattcgtgatcgttttgatttcttcaccggcatcctgttcccggacattgatgacatgcgtcgcgcccatttttttcgcggcatctaaccgcagcggctccaagtcggtcacaatgattgtgcctgccccgtatgctttcgctgccgcaacggccatcagccccacaggacccatgcccatgatcgcaaccgtggaaccgggctgaagcttcgttctcgcggccgcatgaatgccgacagaaaacggttcgatcaaagccgcatcttcataggaaagtgaatccggaatcgaaaaaacaaagtcctggcgcattttgatatattggacaaacgcgccgtcaaccggcggtgtcgccaaaaactgtacatccgggcaaagattataacgcccttctttgcacgcttcacagcgcccgcatgtgacaccgggttcgacggcgacccggtctcctattttaaattgatcgacagacgatccgacggcggcaatttctcccgcgcattcatgaccgaggataaatggtttttccactacataattgccgattctgccatttgtatagtaatgcagatcagatccgcaaattccgacagccatcaccttaatcaacacttcatcatgattgatgtcaggcacgggcaatgtttcgattttgatttctctcgtgctgtgcataaccgccgctttcatgttttgaggcactgtgtgagtcatttggcaaaatcctttctctgctttgaaatgtaagtgcatacatttttgttttctctgttactgcccctattttatctgcttttccatacgttcaacagcctttcctgctgtataaaaggacagccgcactgtactttttattttttcatatacaaaaaacactgaattgataaaatagtactaataggaggtgcaggctaatggctgaactagaaaaccggacacaatttgcagaactgctggcacctgccgtcaaatcgctgaaacttcatcctgattataaagtcagaaggaaaaagaacgaaaaaacaggacagtcttatatcgatcaaatcgcactccgattaggcgtttcctctaacacgatcaaaagctggatcggacagatgggcgcaaactacattcccggacgaattgacgacggaaagctgttcggcatgatctggatcattatcgaaaagactgacatggatactgaatggctgaccggccttctggaaaccaccaccattcccgtcatcaaacccgcattgcccgtttggacggcgtcttgtctaaaaaaagcaaaaatacaccggaaagacggatcattcggagcgccgagtgatgaagatgttgaaaaagcagtaaagcggctgtttcatgacagacccggccatgaaacgaatgcgcttacagaacagcccgtcacgcataacttaccgtcacgccggaccgggaactttatcggacgcggctttgatatagaggcgatccggcaatggatgctgtctccgtcaccggtctgtttaatcacaggctgggccggcatgggaaaaaccacaatcgctcttgaagcagcctacctttgtgccggcggttcaccagattggcctgcattcaacagcatcatttggatcagcgctgactggaaaggattgagcttcagcgattttttaaacacgatcgcctatcagctcggacgcgcagaacaaatagacaaatccatcaacgaaaaacggttcgtcgtccgtaatgcattagccgctcattcaaacgaaaaacccgtgctgctgatcgttgacagcatcgatacagcggaacgtgacattcacgaatttatcatcggtcttccggaaggcgtaaaagttctccttacggcacgggaaaacgtaaaacagacataccgggacggcctcggggaactggcggccatccagctgagcggccttgaacaaacggatgcccttgaatttttccatcaagaagtgcaccgctgtctgcaaacatgcaacctcccgcaaaaacgggaaaagctggagcagctgcggcggctatcgcctgaccttaagaatgaattcgtctcggcagccgccggcaacccgaaggccatggcactgagcattgcatacatgtcagacgacgacatccccgctccccagctcattcaagaacttaaacaagcgggctactcattattggaattgtttgaggttctctttggccgcacatgggacagatgtcatgaagacacacggaaactatggcagacgctttgctttttcgctaagccccctgatgaaaaaagcttggctcaagcggccggattagacgtccggcggtttcattacgcgattgagcaaatgcggtcatatgctttaatacagccggaacgaagcgaaggaagaattcaatacgcagcccatcaaaccgttgtcgcttacggagaacagcacttatccgaaaatcacgaatttgaaaaaggagcccgcagccgctgggcgcattattatatcgattatgcggaaacccatataaagcgggaacagcccaattctgtctattggagctatctgctgggacggaatttagagcaaatgaaaaaggaatggccgaacatcctaaaggtcatcgaatggtcgagtgaaaccggacaacatgacatcctgatcaaactcatcatccgcatcagccattttctaagcagaatcaacctgcccctgcgaatcgaatacggattaaaagccgccgatgccgcccgtcaatcaggcgaacacacgcgggaagcctacttcaggatcgacacggcaggctgggcgctgatggaagttaatgatgcggacgaagccctcaggcaaatagaagccggcctgaagatactcgaacaatcaggcgcgccggatcacgacgacttgaaagtatggggaatcgccctgcaatcgaggctgctgttaaaaaccggagaaccggacaaagcggcagcaatgctggacggcatcaaagatcagcccgtctcccccattatccggcacagggttcttctggtccgcggcgacctgagtttcgcccgctctcactacgaagaagccatcacattatacgaagcggcaaacacaaccagcgccgcatacggcggcgaaaaaacgatagaagcctatttcaacctgggcatggcttacgtcaagtgtgatcaactcgaaaaagcggaaaaagcctttgaacaaatgctctatgacaaacacaacgccaatcaagttgagttgatctattactattacggaatggcacagctgttgtatcgtaaaggagaaaatacgaaagcgatggaatcgaatcagaaggccattcgtctgattgattcgtgggagcctgggattgggattcggggtgaggtggagcagctgagaatggtgcttgaaggaaatgaggaaatcacattgtagttaggaaagtgtgaggtcaatcttagacaaacgatctcataccttctcttttttataaacaaaaaaggtcttatctagttgagtaactgataagacctttctgatagaacgctatgagcatttcaagtgaactcaacagtcaatcccttggtatacccaagggagattacatcatgccgcccataattaccacggttttcgctcgctttcgcaccctttcaatcggtgttatttttttagtgtgatcatgaatggaaaagaaacaaaaaccgcattgtttcagaccctgacgcaactttcgttatttttgtgttattttttaaaaaataacaggtttgtttgcatcgcgaacacacgttctttataatcgtctccaaggagatgaaacacaatgaccgattttgagcgtaaagtgtatcggattatttttaatatgacccgcttcgggaaaaatccctccatggaacaattgaaaaggaaaaccgggaaagatgagcagacgatccgtgctgctgtgaagaatttgatgaggcagcgcattttgaagtgggataagcataaaaacaggtggaattttaaataaaaaagaaagcagggtatctccctgctttctttagcgaatatgtagcgaatagtaataatagcgtatgtgttttctaatgtgtattcataatacatccaatatatatttcctgtcaagcaaaaaagcaattattttacaacttgtgcttgatcttctgattcagttattttagctaaccctaattcagaacataagatttgatttttggaactgccctttaatttacctttgcttaacacttttgtctcttcaacaataaagctcttttgtttaagttcctctaaaatctcactaataatctctgctggggtcgataatgtatttattagatatcttttgaaccaactcaagcctaagaacagatctccttgtgtaccaaagctatcgtgccatttctttatctcaacaagaatttgattcataagtttatctcggtcatactgcttttcttcaataccaagtaaactcgccaaatcttcagcatgatgagcataattcttaaattcaatatgtttaggagcgtttttagctgaataataaagctcaactctttttcccttgtacattaatctactcataataggaatcatgtcactatcagctgttacaaaaacataacaactaatcgaaggatccttgtatgtattttcaatagcatcaatacaaagttcaatatctgatgcatttttacgatgatccccatcttttccatttgaataaacatgccttatttgaacacgctttttttgaagacttgtcatattacttcttaatttgttaaaatccgcatacactctaaatgaacgtacattgtcttgaccgtatcgttcccataaccttgaaaataaatttttatcttcagattgataatctggatcatggctataattattcattagagaccagtaaacgttatcataatcaacaaaaatagctacattatcaagttttctttcagaattaaacgttcgattcgaatcgttcaccacagatgtcatgatttggaatgctgatttaagctgttcgtcaactgctggttgtggtaatggctgggcaaccgtccctgttcttttttcttttaattcgtccaattaaattccctcatttcattagaaataacacacataaaagaatttaccatatattcaccaataaaagtatattttttgacttcatactagcttaaaagttatgtatttctcccatttacaacaaaaaaagcctcgtccattggacgaggctatatcacttcaataatttttcaagtttcgcttttgttttcggcccataaatgccatcagcaggcagcccgtacatagactggaaccgtttgactgcatttgctgttttcgcgccatatgagccgtcaattccgaagttctttgcgctcttatcggggtaataatgaagagccgccagcgcggtttgaatctgttttacggcctccctcgggtcaatgggcttgtcactttaaaaacacccgcaggcagactgaattttgatttttgagtggttttaggctttgaggcttttaccttcttttggccgccgcttttcagctcgttatcgcttttgatatatgagacattcacatatccgtggaatgtctggcctttagaattggtgtattcaacatatccccatccgttgacagttgatccaagctgatattttacaaccgtgccattcggcaggttaagcaccatggaagaagaggcgctccgttgtgtacgtaaaacaaggccatcgcttgaaaccaccgtgtttttgatgaatcttcctgtgtctgtatgggtaacatccggatttgatacaggcgccgttacaaccacaccatccattcgcttttcaacacggctcttaaaatcggcaaacccttgagagttgcttacccacggcgccgggcaaattttatgtgtaatgtcataatgtcgaacaatatcattggttggatcaagtttgtacattttgcacagctcggcacaaacttgtcctgcacgggcaatcgtatccggatggaaagtgccgttcttttcaatgcaaagctccacgccgatagataagaaatttgcattcggtttcagcgccgcgacaccccggtaaggctgcccgttgacgaattgctgaatgtcattcgcatgataggcaacctcattcaacggaatgatacaaatagcctctgtacgatcgacaaagatatgtgcagatgcaaacgtctgttttttctcagatagatttctgttctgtgcggggagcgtttggccaaaatatctataatgattggcagcaggcgcgccggggttggccgtgtaatgcaccacaagtttcttcacgccgttgtttttgattcccggccgcgtccatttattaatatcaatatattggtttctgtatgctgacataaaatctctcctattctgtttttggattcaaaaaagcagccggattaaccagccgcctgatcatctttttcttttgtctgatcgttgtcgctttcaattacgtgaagccggtcagtgatgacggccggaattttaacgccgatctgcgccaaattctccgtgatggacaggccctcatttgcgatataaaaaagaacggttccaaaggtcaggacgccgttcaaatttgttatcgtatcaataatgttggcgacgatgaccaccataaaactgagcatcttccgcacatacccaaaccacgcgctgcggctccggagctgcttcattttccacgctttgataatgccggtgatgacatccaagatgctgaggattagaagcaagtcaaggtacttcacctccccgaaaagatatgttcttgcgatctgtaagctttcaaaattcatccacacatgtattccctccattttgatcacctccttcgaggcaaaataaaaacacctattcagttacaggtgctggttcactattattttctttcgccgctactgccgcatttaattgcttttcgagttcctcgcgtttattatctgtaaacgtgtatagcgctttatattcggccagctcattgttcttcagattcaattcctgctgtagggaagcagctttatatgctgctatttgtaactggtcctgaagttgctcttttgtcatttcttgcatgcctttcactccttactcttgatcgggatacgcattaccgcgttcgctttctgtaatttcatcatattccgcttgtgtgatgcggcctttctcaacggcttttctcatttcaacggtcaaaacagttccgtttttccagcaatcctcaaaaaacccgaaaagagcacttcggttctccaatgggctccccccgtttccttttattgattcattaagagattgcaaacccgctgaaggtcaagaacttgttcctgcaacttttcctctgtagtcttttccttctctctatcttttgcttcaatatttaataccacgggctcaagcttcatctttgccatcctccttattttgaacatagattgttataagcccttctcggttgccttgtggatcaacgacaatttgaactggaatcataataagctttttgctcccactgtacccttgataataaccgtcaggctctacataagtttttgtgagcaaataacttatttcatcagcctttatatcatgaaggacatataattgatacgctacttttgttgtatcgtccggctgcagatcgaacgaaacagcctccatgggatatgtcttgtctcctttttttatagagccggcagttatttcaattcccgcgccggtttcttctatttcgatgccgtccgcataataaagactcatgttaaaatcccttttttcaaccataaaaattactcccttattgtgattcgtaaaaaataacaatttgaacctttattgtttttcccgcaactccggcagtagtcccggtccctctcactccaatatcaacagaactggcgcttatattttctaatcctaccgtaaccgcattagaatatgcgccaatcgctgtacctaccgccgcaaaaacgttctcaggcgcataatcaaaactatcaacaaaaggaatgcgattgtagcgcgcgtacgcagttgcccctccgtcaggcggcagtttaatgtcccaagtaaagcagtaaaccatcaaaccgtattgtaggcctccatgctcgtcttctaattctgtagaaacattgccacccatcaatttgaattcgcaattttttgcattccctgctacaactttggttcccaatggcagcgttaaatctgatgcatcaacaatcgttttttggcctgatttcagtcgaatgaccccggggacatcaatatctaaattattcggtttaaagcgataaatagtagctgatccttcaaaaagggcctgataacggttatatgtgaacggctctcctatatttttaggattggtagtagcagtaagaagaaaagcgtcttcttcaacagctgcctgtctttccattttcatattaaaatggcttataacttgtccaacatctcctatttctgaatacattgaaatagttggaaccgtttcatatgcggtttgcttgcctgcgccacggagctctattttgccatcaccaattgaaactgttctgtagatttcattataggaatcaccaggatcaaaaaactttccttgttcctgcgttattttcccagaactaacaatcaatttgttgtaaacataatgagagtctctggtgtactggtaaatcttatcgccttcgatatagtattcggcatcttctgattgtgtcagcgcctcgaaacgggccccttttatggtcaccccctcaatcgtgataccttttaacgtcccgacatttattttgtccgctgaaaggtctttgatcttggcgtttgttattgaaccgtcaatgatgtgtaccgaatcaattattgcttcttttagatgcgcctttgcgatagccgcattttgaatagccgctgtcccgatagccgcttcagctactttcgcacttgttatggctgcattttttatatgagctgtttctattaccgccttttggaggtggtcgccatcaataacaccatcaaccagctgagtatcaaacgggctataaccataatcagaaatgacatcgcctttgcgcacctgtaccttacgaataacaaagctacagggctcagtgtttccgtttcgattatatccgccgattccaattgtgtaatcagagccggtttccggagcagtaaatttgatattaacccttataaattggtcagacggaaaagcagaaatatctttctgttcatcgctgctaatctgtatgaaagtgctgccttttttcaaatgaatataacttatgtcggtggtattattccgttttatttcaaatgacagtgtatattgttgatctttgatcaatgccattctttgaatattaacaggcgatgacctgttcccgcatattccgaaagctattctagttgttccattgatgatctgagaaacagtcatttcattaaattctttttcctcaacactgtggctggtgtccgtataatcatagaaccatttagattttaaaagagagccaggtaagatattagcatcatcaaagtttcttgaaagtttatcagcatcaacggccagctgggccagtttttcctttgtgatcgctccgaaaacaatgtcatcagtcaaaatgcgctgagtggtcgcggaaaactgatccgtgaattcgctcgctgtgcctcgtgtgttgattgagcgcaagcgataataccaaacttcatttactcccgtaaaatgctcatatccgcctgttttgcctctgaaaatacgattctcttttaatggagtgaatccatttacttgtgaagcatatacctcataggctgcaatataactggacggatcataatcccatgtcagggccacattctgaaacattgccttgatcactacattcgacggaactggcggggctttgtcagggaaacttccatccgtaacctccccggcatccggtttgctttcccaagtaccgcggtttttttctatcacgctttcaatttgatcaatccggccgtctttttgtaatgctgataaaaattggccgatctcaacaacgcaagtattttcagggtcggtaatatcgtattccattgaaataatgcgctgcgatgtctcgattgggatagcgaagtttcgatcaattgcgatcgttgtatctcccaattccacatgttcgtgttcgtgtcccggcacgctctcaagcagctgcacagacaactcataattgatttctgtcttacatgcagtcgttatcaaatgattatatgtggcctttaaaagctcttccggctccgttatgtcttcatcattgtattggccttccctatggatcaactttccatctttaaggcgccccaatcgttctaataaatccggatcgccaacccattcctggcctaaaggcttatcgaccgggtcgccttttgattttttccattctacttcagagaaatcaataaaacgagaatagccgcccgtttcctctccttcctcatccgtagatgctatggatgccccgtaaccccaaagggctgtcaccgggtaactgataacagtccgccggatattcgttgtatccttatcactctcaaagcgcttcccgctgtctttaccgcgacggggaagtatttttatgattcgtttgacgaccttatttccatcaaattctatagtgtcctgaagctctccgccccatatattgatcacgtcagcaatacaatccaacgctgtttttttatagaaggtagtcgaattcactccaagctccgccgttacttccgccacccatcttgaccgagaaaggacgttgtccagtacaaactgagcagttttgttagttgggcggaaatcttttacaaatgtttcggcaagctccatcatggcagcctcacaggtaacctgggtgttaacctctccttcttcgtctgcatcatccagttccttgatgacaaacagacgcattacaccgtccttatccttgaataccacttgattctcttcgaataggaagcgcgcatcagggtgggaggcatcggctacaaaagaaaaagaagagcccttgttgagctcttctttgtatttcgcatcccagaacgtacaggtttctcgtccgtggctggacagcactgtcaataatttatcatctggtgaaagtatataaatgtcagccatgaccggacctccttacaaatatgcctcattaaatttgatgctgctcttatgactgaacttgattttaactggcgtcctaggcggcagcagaaaccaatctgattgaatttgaagtgctgtcatgattaaattaccgctgcaagtgacttttctttttgcagaatcaattacaagtgtgtcaccagcgatgaaatcgtacagcagcttgatcgttttcgatacagacccatcaccattaagaagagccacttcatatgaagtggctttctcttcaaagacgcattcgattgtcgggtctacggccgcatagcccggattagtgatagtctgaatacctgaattaaattcaaaatccttcgccgggccgtatttttttggatcaggacagataaaagtcaatgttgcagtctgaaagcctccctgttcttcgccttctgaaatgctttcaaagacagcattatagactctgtcaggctcatcgtgaaaaattaacggtttaggttcttcggtgtgcagaataaaagtcagttcctcctgctttttcttcagctcttcttcactgctgaaagcaaaaagaacctcaacggttatgactcttacaggaattcttgtgttccgcaggaaaccgccggggcgattcccgatagtggctgtattcacttctcttccggtcactccccggccgcccgtggacttcacataaaagaagggtgatatatcaatgccgtcaaacgtgattttccattgattaggcagcagttcctgataattgatcaattaaatctcgtcctccttgcgttcgaccttttctgagcgtctgtgaccggtttttctacgccttgaccgaccttcttgctgtccatctcaacaacaatcatcctgtcaggcaattcaaggttccggatgtccgcgctcaattcttttctaaccgtgccgagttcgctgctggaaatggatgtgtcatatgcaaaattcagatcctcctgctgaatagtcatggcatcactgacgacgcccatagctttctgaacagtgccgataccattctgaatccccacagcgataccggcaggaaccatgaccccgacctgatcccgcatcaatctggatggggaatggattttcaatttcttcttaatcgttttttcaattgtcgaggcgatggaatttgcttctttcgccagctcgcccttcatattcttcattccagaaataatgccggccattgtatttgaaccgatggcttttccgcttttcttgagagaaccaagctgttttacatccactgtaagctccccaattttgcggagatagtcatttttcaaaagtgccagttctttatttgcggcagaccgtaattcatttattttcttggtcgtcgcgttcttcaacccggttaattcttgagcagcctggtcactggccagcttgtgcttttctttccacagactgacatactcatttagctctgaatctgtcatgcgggctattgcattaatctgatcagctgacccgacacccatttctttcaattcgtctgtgaatgcctttggtgcccggcttgctatttttgtaatgtcagtgttgaacgttttgatcttgtccagctgctttttaagatttgaagtcagcttggagccgttcacattttgacttgagacatcgtcaaatagaccgatggcgttataaatcgcgtcagttcggtcttgcagctcctttttataggcatcgttggccgccttaatatcggcagtcagtttatcattcacttttttgaattttgagagataagtattgtttgcagaaagaatgcccttgttaagtttgtcagccgctttcttttcggcttccttctgctttctggccttatcagtcatagctttttgagtctgatagatttcccgttgaacctttatttgctggtcagaattcagcttgttcttcttcttgattttctcaagcgttttgatataggtattcccgctgatttttcctgtatcgtattttgcctcagctttcttaatctgatctgatactttcttggtatacgccagtttcgccttcgcttccttgcgctgctgctctttcagtagcttcttctgtttatcagaggcgcttttggatgcctgatatatctcgcgctggatttttcggttttgctcactggtcagcttgttttgcttctgaatcttctgcaatgttttgatatacgtatcggcgcccattttcttggtgtcatacttcacttcagcgttcttaattttgttggatacctttacctcagccgccttctgagccgctttcgctgcttttgccgcagccgcttttacttttccctgtgatttatcaatacctgccgccataccggtgccgacgtgataaccgacctggtcacgcattacccttgacggtgaatggattcccagaagctttttcatgccgttaggaattgcgtttgccattgatttaactttgctcgctaatgcacccgccatgccgctgataccatttattaagccttgtatgatgttgcggccaatggacttgaggttgatgcctctaaaaaatttcatgacactattccaaatgctgacgatacgttcttttgttgcttggatacggtttacgatttgcgctttcatgtaactaaatgctgtagaagccgcgcctttaatgccgttccaaatggacatcactttgcttttcactgtattccagaggcttattactctgtctctcgtcgctacaattctattgacgatttgcgcccgcatgtagttgaaggctgttacagctgcactttttaaagcattccagacagatgtcactttgctttttatcgcgttccacaaactgaccattttgtctctggttgcaataatccgattcacaatttgtgcgcgcatataggtgaaagcagtcactgcagcacttttcagagcattccatatggacgagactttactcttaattgcattccagatgctgatcattttatctctcgtcgcaatgatcctgttaacgatctgggcccgcatatacgtaaaggctgtgacagccgccgatttgagacctgaccaaattgatgtaacggtgttcttaatgccgttccatattgaagtcgcagtctttttaatcccattccagacagaagaggcaaacgattttatagcattccaaactgttgtgaaaatggttttgtacagattgaattcccacttaaaaaaagcagatagcccgttccaaatggttttagcagccgaaacaattccattccaaacagtggagaagaacgacgttattgcgttccatgttgatgttgccgctgttttaatgccttcccatacagattggagccactgagatatgacaccccaaacttgaagggtgtactgcttgaccttatcccaattggcaataatgagaacaactaaggctataaccgccgccgtaatccacccgataggccccattgcgatgacccatgatgctgccatgcgcgccgcatttgccgctgcttgagccgccagaatgaccaagcgtttaccaaataagatcatttgcttaattcctgccgccaacattgacacaaatgaactgatttttgccgcagtccacgccgctgccatacgtgttgcttgggctgctgattttgctgctaaaacagttattctggcaatgaaaagtcccatctgcttaatgccgtttttcagcattgttataaaagaaccgattttcatcgcagtccatgatgctgccattttcacagcattagctgttgcttttgctgccataacggtatatctcgcaatgaattgccctatagtaactatcgctgattttaattgggtgatcaatccggccattctaattccggatgcggcagaactgaaactccgaatatatcgagcagcagtcataaagtctttaagcccatttgttacagcactgactgctactatcgccggaacaatagctcttaaagcaccgattaatgaaatacccgccgcaatgaacttcccgattgccgggtttgcttccatcgccgcattagtaaatttcaaaaacccgtttacattctccaaaatcgttttgcctagtggagccatgccaacaagcaagttgatgatagttttcgcgatctgccccaatgtgctccatactgtagggccgttggttttaatatagtcaatgaacgattgaaattcttttgttttcgtaacgctgccagcccactcattgaaccgcttggtcaggtctacgagggatgtcatcatgtcttgagacataggagcgaatccagtaaacagctttgtcaggccgcccgaaaagtttctgataatctgcaacaattttgggccgttggtttttgtatactccacgaaagcctggaatttctttgaggagcctaagttcgctgaccatttcacccatgattgcgtcattccttcgatagactttgtcatgctctttccggtcggtccgaatgctacgatgagattgaaaactgtccgcaagacattcccggcagatcggccgaatgaagcaaacgccttcggagcttctttgttcagataggaaatgaatctctgcatgtccggagccttgaaagccttgtccatgctttttgccagtcccacgccctctttcgccagcccgtcaaacattggaatcagtgagttaagcgcgagtttgaacgtattaagagacataccgaatgtttttaagatcggcttttgaaccatcgtaccgatgtcccgccagttgtctttaaagtcttcgaggttctttaatgcctctctctcttcttttccaagagatttttgcagattattgatctgtttcatgattttagcgcgctcttttgcgcttgttgcattgtccagcttctcctgtagcttggaaaggtcttcggatgctttgaatacaccgcttatcgaagtaatagcaagggcgccgaatgccgccgcgcctgttcccgctgttgcaaatgcactggttaaccccattactccgccggctgccactccgagcatagggcccaatgagccgattgctccgacaatacttgcaagggctggcgagattgcaggaagtagggacgttaatgccccggcaattgaatgaccgatgaccgttgaaactgagtttgtgatcttggcaagcctgttcattgacgtttcaaaccgatcaattcgagcttctatactaatccatactcttctcggcaaggacgccagagcagcgcgtgccgttgccacagagcgcataagcgcagccgtgtttccgtttatgaccgtggtaattctgtttggcagtgaagccaaagctgaacggacagccgaaaccccgcgcatgataggcgacgtggccgcattaaaagtggtagttacgttatgagatactgatgctatggctgaccgcgcaacagcgacagcacgccctaaaggagtgggatttccgtctatcgtcgttgtgattctgttcgccaccgccgatagccctgctttagcgcgtgccaatgcggaagataacggccgcacattccccattaattgcgtggtgacagtttggggaatctgtcttaatctttgcttcgcccaattgatggcccgagttaaagggtctgaatccgcatctaaatcaactcgcgtgcgttgatgtcgatgaacaaagttatctatttgttgcgccgcctgccgtactcttgcctgaaagctggcaatctcggcgtcaacctcgactgtgtgatgatcagccatccggcgcattatatcgttgacacgatccatactgcgattaaattttcttgtctgtgcttcaactattgctgtcagtctttcgatcattccctcaccccattccttgtccgaattttgcaaagtggttgcggattgcatcattaaaccgctgaacccctttggctcgtttgccgagctcgtttacatctgacttgcgccatttgtcgttatcgccagtgatattgcgctccaattggcgtctggccttcttcgcatcaaacattttcgtttctttggggcgcttctcattcatggcgtaacgatgaaacatggcgtttcttgccataagctccaattcatctatttctcgcaacttggctcctttgagcagaagcttgtactcgttaggagtccatgacatgattaaatccacatcataaaccccgagccaatgtgcggagttcgtaattatttggtcgtagtcgatcccgttctctctttgtatgcctctttcatcatcttcaagacttccttgccgttctcttcgtcctccaaccgtttcgcttccatttccggtgtttcgttcggagctggtttcttccctttgttcatcttctccatcatcttccaacgctgacggattacgcctttgaaaaaacccgctgaatccagtgttgtgaatgcttcattgatcatcttgtcaattgcgtcgcctgtctcgtcttcatcaatgattttcatgattgcttcttcaatagcctcagttgatggcttttctttcttcaagtaagcgagtgcacaatcccaaaaagcagaaagataggaagcctcttcgttgagcagactcatgtaaatattcattgtgccgcctttgcccttttcgtccgcagtggaatatttttcgtttgccaatctgtcaaaagcaaagtcgcagcgtgatttgtattctttatctccgatagttaagtaagccatttataaaacctccgattatttttgtatgttaaaaaagagcccgggaagcccggaccctatgattccttttctgttcgtatcgtaaaattggccgatcgttccgattccccagccgagttcactgccgacacattaaaaatgtaggcagtgtccggcttcaggttaggattcgacgtgtacgaattctttgagacagtcgctatttttgcataaaacctgtaaatattgtaagatgtcgcccctttcaccgcatcccatgaaaaactcacctgatttgaagtggcgcttttcgcagttatattgcggggaacgttagggcgtaaccgcttgtgtttgcgtaacaatctcagtcattgaggactcacccgcatcgttcacagcagagacgttgaccgtgagtttcgtatcggccgcaattcctgtcaaggtgtgggatgtgccagtgacagttgcgtccagctgcttgctcgctcccctgtataccttatatgaagttgccccatctaccgcatcccatttcacggtcacgctgtcagctgtagccgtgaacgatagattttggggcgcattagggcgtagttgtttttttggcattctcgccaaactgcatgaactctttggcaccggcagaagatctgatctcgtcaattaattcttgaggcagaggatcaagttcacctttacgggtcttaccgagaacaggcaatgttgttgaaacctcaataaacccatcttgcggtgcacttttttctaagttctcgatgattgcatgtccatattcagaatcatgcttatcgtttttgtttttattcaggtttactttccatacctgaactgtctcttcgttgtcataagcatcttcaatcgccgtttgacccggatcagagacagcagcatagtatgtcagttcgatgctctcagatttagggccgtacccaacaattcggccagactttgttgattcatcttttgtatcttgttctttcgtatgactgccttctgtttggaatgcgataaacagaccttcagttgaagtagcattcatcggttgaacaaagtaaacctcatcaataccattcaataaatctgccattttgttcatcctctcaattgtttattgtgaagcgcattctgagaatgccgtgacgcgtgtacccgtcaatatcggtgatcacctgcatgctgcgcaactcagaacggcataaagaaaagccctctattgttaggggcctgcttgttaacgcttgaagcatgaggctcaaaatctccatcgcttctttttttccgttgtaacctgaccagcagtgtaaaaccacattgatttcttcaccgctggatgtcttggttttaaatggggatacatcatcatcgcccattgtcacataaggcttttgctgatctttcgggactgcatcaaagacgcccgtgacgcgcccgttcagctcttcgtctgttgataacctcttaaataaagcagcctgcaacggccacagggcagatcgcatgatgacagctcctttctatcacatttgactggcaaaataccgcatgccttcgtccaccgctggattccagaacggctgtgcccgcattccccgcgtgaccacccatctattaagcttggtgtcataataaacccacggcgtttgccggccgccgccttcctctgcgtaaatccctgttccgtattccacatatacggcataatcggcaccaacagaaataacggcccgtaagccgccctcttggtagtcgatttcaattgaatttttcaagttcccccgtctattgcggcggtcggagcattcagaacagcgtggctgtaaatcagctcggccgtgtctgtgaccagttgcttaatatcatctatgacccggcttctgaactcgcttgtggctctttgcatctgcctgacccatctaccactgacctcagccattgcccttcagcacccccgtaacctgacatttcaaattcataatctcatgcatgccgccctggtcgatcggatctgatttgagagtcagcaccttgttctcgtagatgatccgcattgtcttctcaatatcattgcgatacgggaaatacacattgaaatcaaccgggttctgaagctgctgagcctgataatattcccgggacgtaatcccgccgacaaaggcctctattgtgagataatcagtgaatttttcaacatagcccccgccgccgtccggcacctcttcccaacgctgaaatgtaacgatatgcgggaattcttcatagatcatatgactctcagctttctgtatggagcaagaagcttcgtaatgctgcttggcagctctgtttcataagaatatgagacatctcccatacttcggcctgaaaggttggaaggagtcatgttatgctcgatcgctttcgcgacatacagctttacccctgctggtaatttttcatctccattgaccatgaatgagttgttgcaccagtctttcgcttgatctatgaacagaggtaggacctcggccagataggtatcgtggctgtctgtttttatgccaagcatattttttacggtttgaacatccatagaatcacctacacttcaccgagaacaattttgatcagttcctctttaggcgctttgggatcaaattcatattcgttctccttaagaaaggcaacgatttcatccttattcacctttttcaattgctcttcagtcatatcaagaaggtttgtacccggccgttcattcagctctttagattgtttggcctcatccactctcttaaaaccaatgtgagaataaaccacctcaaaagccttttcagtgcattcaatagttttggaaccgttagatgctttcatatcacgcgccgcctccttccagtgcttttatccgattctctaaatcagatagtttggctttcacatcgtcaccgagtttagctaaagtaactgccttggcaccgatgttggcattttgtacactaccagtgccgatgttacgattttggacagaacagtcaccgatattgatgtttttcacttctccgtcgccgatcatttccgaagtgatagttttaggagcaggcgcagaacccgataacccagtcaccttcgcaccctcttttatttcgagctcgccgccgatcaccaatttgtcgccgttattagtgctatagtttttagatgtgtaccccataagcttacgcctccgttgctggtgtaatagcagcaaaagcatcatcggtcagtgtcatgaatccgacttgctgagttacacggagagcaaccatatctctctcatacaagttgatcgggtttccgtctgcatcgacaatcgttgtcaatgttgcatcctctgagattttgtattccatgccttgagggattccgtaacgtgtgtaattccagtcagccgcaagtaatgccgctttttcgtaatcccatgacttagaatccacatatccgatcggaaggccaagggcttgttgtgtggcgccgcctgtcgcatcgttgaagatcggaaggccgttaccgtccttagtgccgcggagcttttgacggaatcggcgtgttgttgtaaagccgtttacatctttgtcagcgtcttcaacaagagccatgaccccgtttaactcatcatatagattgccaagtgagtttaacgcaattgtgttaccagattccttgattttttcaaatacagatacgccttttccaaacggtgaatctacaccgaataacgcagcctgatcaaatttgatcgcaaaggcttcagcgatagcagggcgcatttgtgtgaagaaatctgttacagagtagcgcaagaattctttagaaacagggatgatgacacccaatttctttgaaatcatttttgctgttaaccattgagccttagaagtttggattctctcgccttctccaacccagtaagctcccggtccagaagccaagtacgtgaattccttctccggcttactcatttcttcatattttgctagttttgtgacagcagattgggtcataaactcttttaaaaccagcgttccttgttcggttggaaccttcccatttactgagtcttgcattaatgcattgtttggattaaatgttggcattaaaaatagccctccttattttctaatacttgcttcagctgcaagcgagctgatgtctaaatcttgatttgtcggttcattgctaccggactggacatcacggccattctcttgaaacttggattcaatagccttttgaagtgcagcattgtacttctcttcgaatgctccgaggttcttcatcgttgattcttcatcctcaccgataaagaattccactacatctgccggcagttgcttttcagaagcataagaaacagctttgtttaaaagcttttcacgttgtgccgctgtcttttgatcttccagctccttttcgagcttcctgatccgcttctgctcttctgtttcttctggataaagctcttttacctttgcatcaatcagagcatcgaggttgttcgccttccacgtatcaagaccttttgtaaaatgagaatccaaccgaggctgaatgagacgttttccttcttctgtatctaaaaacccattcaccttgtcagcagacacggcagaaagttcattcagatacgcctttacatcttcgttttctttattttcttcgagaaattttttcacatcttctaaagttggcattacgcttcttcctccttcgccctctacagtgcgcgcctgttatgagtgcatgaaaaataagccttttaacgtcatgctcaggacaaaataaaaagccgctgtttaacgtcttcccttttcctcaatggatttgtaccactcttcataggtttggtatggaattgtttggcctgccccactgccgccttccctcgcccttctcgtatccggcagcacaccgtttactttaaaagcaatcgtacaacggcaatttatgtcatctttcgcattattcatgtgccccggagccggcccgactccgccgtaaattgatttgaacagcccattgcgttctattgtcttcccgtccagtttcctgtgcccggctcgtgttttaagatcaagagtagcattccacatctttttaaggttgctccgttttgaggccttctcagcgctttccatcctcgccgagacttgtaccctatgagcttctgttctcgccacgtcacgggctttcctgcgggcaaattcggtcgctctttcaatgcggcgggcgatcttggaataatcctcccccgcttgtaggccctgtgcgacggaaatttgaatctgccggacataatcgtctcgatgccgcctgtaaatagctgacaaagtcaattcagctatagggtttagaatggcctgccgaatgacttcggctgtcgggatgctaaaacccaagttaaccacggattccatttcaaatagataagcagaacgcatataattctctaaaaactgcttggctgctaatgcctcaacaatagtcagaatggttttgaaagccttgtgagattcctcggccatcctctccatttccttgttcagacgattgtatttgttggcatcggctaaagtaagctggccgtccttgctgtacttcgcatacagccgggcaatttgtgcgttgatctcctttaagcgagacgcaaaaacgacatcaatcttctgagcatcctcagtgatcatgtcgtccaggtacttatcaatatcattctggttcatcttcatcaccgcccgcgtctgtttccacatccgttaacggcggcatgttgagcctgtattcctcttcttcctcttccatcttcttcagctcatactggacatcatcaacaaacgacagcagagataggcgagtttcttcgcttaccattcctttaagttgccctgtcgtttgtgcttcttccagtacatttgccggaaggtttcgcttaaatccgaaccaaacttttttataatcttccgctgccgctttccttttagtgccccatgcggaaaagatcagtttgtattgataacgcagagcagcagtcattttccgctccatcgtgatgcatttgttttcaagcgacatcaatttatatttcatcgcaacccctgaaacattcccaccaaaagattcatcggagaaattgaccgattttgcaaagcgaaggatattctcttccaacctatcaagatggttttctatgatggcatcgtttatatcctttgtcagatagcttacgtcatctttttcgtcaagcaattcaaggactccggtctttttgagctggtcaagcgtctcttcatcagcgcccaacccttttaaaatcaggtatgccagccgatattgctcaatctcattcgatgcatcggacaacgtgcggtcatacgcatcaattaacgaaagaaccttttcagcatctccctttagttccttgttattcgctaaaccgaataaggggcagccatcaaaaagatgcaatgtttttttatcaaaagtgaaggctgagctgtctttcgtactgaaataatagacatatttctgatcatagaattctgctttgatctttccgccgtacaccgtgtaatatcgcaaagcataagcaggttcatggatacttccatcagtaataaaggcgcattcccatggatcaatattttttatacgctcgtttccagaacgatcaacgtaagcgaggcgggcgccgtaaccgcaaatagaggccattttcccccactcgctgtcttcatcagcaatgttattttccatattaaaattttcgatcaactgttttacaggtattgcagtgcttgtcgtatcgctctcatcaaactcatatgcaatagggtggccgaacaaatagcccacctttgtatcaatgatttcagagtcaaacgagttgttaagcctattgtttactttgtgatcaatacgttttaattttcctgtttcaaaatcttcgtattcaatggcttctctggataagatcggaacgccttgaacctcagcctcgtaccgttcataaagctttttcattctgtcatgatccggcttatgttcctgaatgatcttgtcaatcaattcaggcgttatgccggactgttcaatcatgtctataaaatgattcatcagctcacccctctccgtcttttcggtttattatgcgaatacagagcgtaccggagtgagtccagcacgtcgtcccattccttaaccggttcgcctgtcttctgattccagacgtacataaagatttcttttttgaaccggtcaactttgtcttcaacaacaaaaagctgttcttgtttgaacagccgcgctacttcttctataccggatacgacagctttatcagcgttaatagcccgaagtttttcacgccggaaacgaacaacgtgttctggtcgtgccgtatcacaatagaaattaatgtttccgtaccgctcttttacgcctttcgctaccttcacccagtaatgaatttcctcatgttgcttggcatattcttcgagcaaataaaaacacccctggtcatcttgtccgattacaacaatagaacccgggtgctcatatccccagtcaacgcccgcaaaatacttcttgaaattgacgcgcctgttttccaattcctcagagctgatatagtggatgtccttattgaaatccttgtatatgactccttctggcgccacccaataaccgtgtatatcccgatctgtaaacatgccgctcggcgttgatgccacgatgctctccacatattccggatcgagaaaattgttgtcgaacagcgagaaatgaaatgacctgatgttcagccgcccgcttttcagcatttgcccgtctttgtcgatataatccgttttgacggtgtgcatcgggttttcgggatttgtatccatcatgaccacagcgcctttatacgagcaccgggaaatgacttctttcacgaatgaatcgtgcagggcagtcgcttcgtttaggaatgcgccggctgatgtgaacccccgcgcttttttccatgaatcagcattggctccatcaaagcaatatacacggttgccgaatatttcaacggcattcgacttgtcgagcctcaattctttacccagaatcagttccatatcgttcaagacatttcgttttatggctgcctgagtagccccgccgatgatgaaggataaacccatattttgatacttactgacgtgagcaaggaacgtcaaaaggagcacgaatgtttttcctgccctctttgcgccgctacaaattagaattttgggttgctctttaataaagctgtcccaaacttccttttgctttttattcagttccatcggcattcaccatttttctcaacattgcagcaatatcattttcttgggtgtttccatcgccgccattaacggtcttcttcgttttctcgatattcaagcgcatctgttccaatttaagacgccgctcatcttgctcatgcgccagctggtcaaattgcttgatcaagctccggagctcccccattgcccgagattgagcgtttaagagagtcgcatgacgatcccaagcgaactgtatttcaagttcttcttctacaatgtttttttcatatgttagattgccatcttcgtcctcatcttgatgataagcgtattttgcctttttaagctcttttgccgtatcatctttattctgcacaaacataatgcgctgcgcccgaataatagccgcatattgtatctgaatctgatcccatatcatatcagcaggggaacgctcctgaatctcttccatgatttcaagcgtttcttccggcagatactttgagaagaacccatgtgatacagcattttgatttcttgccggagccgccccgccgctatttcctaatgcgtttttgttgccgggttgcccgcctatttttgtgtgcacacttttttcggtgggtgcaccctttttcctttcccaaccatgccgctgcttccacgatttgatggtgttcactgacaccccgtatttttcggcaaggtccttgtatttcacgcctttgacgtaatccttatacgcctgaatgtgcttttcaaccatctacattcaccgccgcccccttctgattcgtgtttgttttggaaaatatattccctctaaaccgacgccgcactcagaccgttaaccacctatagttttcctgagacttaccggaaccggtttacaaggaacaaaaaaagcacccttaaaggtgcaggtgctggctttcatttgattctatttctttcataagcgaaaatataatatcagccttaattatataattcattggatacttaataactggttgctcctctttctcacaatttatatagtttactatttgagctgtattaataccaaccaccttattattataaataatggggccgccgctaaaacctccataactaaacatattgcccataaaatagtttaaatggttatggaacaaagacactttgccaaatgaataaataggaagatgctgatttgttaacataggattgacgacacctaaatcagaaaagtcaggataccctatcaaacatagatcatctcctggcgttaactttttatcagaaatgtgtttaaaatccaaaggtgtataatcggatgattctaaatttctcttaaattcaattgtctcattaaaattaagtgatataatagccaagtccatctcaaagtgattattttcataaactacaggcgcctctccagactcaccagatcctaatcgatatatttgatcgacccctacagttttgagattctcagcatatttgtttgctttgtttatagattcatggagctttcctgaatttctattcacaattagatgcttcacagtaataagatattgcttattaccttttttcacataaagagcagtaccaaagtcttgtttatcttcactgtaacattttaaatgaacaattgatttttctattcttttcaaatccatatttctctcaccacttctagaattaatctgaataatataatatgaacaaaagtaacttaatgaaacctatccttttttcttctgtttacttgccttccaatccatatactcatggaatactgtaggtcctgtcacatcgtattttctaccaatccgccacaactcatcttgcatatctttttcaatatcttcccatgatctatgcccttgtttctctaaaaaatcattaaattcttttaccattggcatcatattctcacctcccaccttattatcggttaaggagtgtgataaaggaactatttgcaaaatttgtcgaacgaaagcacttttcataaataggtggcaaccgtaagacaaaaaaacacccttttaacagggtgctcatttccgcctatgtttttggaaatctaaaatatcctctttcagaaaaagcctgtcccggggcatttctttcatcggctctaattccccggtctttactaactggttcagatactgacgggtgaaccccaatatctcaagcgcctcacttgtattgagtatctcttcattcaggaatttcttgattgcgtcacgctctttaggcttgtacatttttgaatcatccttttttctcacgatatttcaagtaaagggaaaatgctttctcgatgatcgaaacaacaaataaaatgatcagactaatgtcgagagccgttttcaacggtcccgctgccacatcctgacggaaaaacagcatatacgccagggcgagaagaacaacaatatcagtagtggactgtacacttttcatttttttgaaagtggctggctttcaagtatttttctttagtcgccgcatttgctatacttggagcaagggagaagcgctaccttctccctcggctcaaaatcatctgcgctttcttggacgtctgcgttttttgattttgggcttttttgctttaagcttttccctgatgatgaggactttctcaacaactgtgagagttgtgaggataatccccagtaccaatgcgatttcagccactttctttccctcctttctatacattaattatacatcgtttatttactcacgtcaagtaatttagtgggcttttttcattatttctccaataaaaaagagcctattcacgctaaacagaataggctgtgatctgctctatttttcattttcaggcgggaacgttcgatgttcttctgcacagttccttttttaatccccaataactgcgctatctcttcgaatgacatgttttgtacagcatgcatcatgaaaatgtctttttctctttcggtaagcacggatagggcatcagcgattctttccttatcccaatcacttacttctccctcagcttcttgaacgattgcgtattcttccggcagcgcatcaattaagcgaggttcagcaagaatcgtcctttgatatgcgtctcttctgtcagcacctcggcgtgcgcccggctgtcttccgttctgcagccattcaagagtgaattcaatatcgctgatcatgctactgataatctttttgtcgttgatctgttcagccgtcagattgacttcagccgtatctttgtagagccgatacatttttcttgtttctcttaaagctcgtttgtactcaatgattaaatcttgcattctgattcctccctttatttgcgcttaaatgcgccgcccttgcctcgtttaagtgtttgcatgtttgtgttcatcatttgttgccagaaacgatctgagcgctcctgcatgtttttattgggctttttctttttctgcttcatgtcatccctccgttcaaataaaaaacggacaccaatcagagcacagtgattctgtgcaatgatcagtgtccgcaggctttccgtcttggacttattcagttaaagcagcacatatgtagcaatgttcccgatgatcgctactatacaaattgcagttaagtgatttcttagctgtgaatccttatcctctcctataactcccataagagagactatcaggaccagcaagagagctattttaaaggctattaacatctctctcctcctaattaagacccatttgattcattccggatttaacagctagaggcaccacgtccgccggctccacatatggattcttcttgtattcctgatagtaagccacaatcagctttgacgtatggctaacaagctgcagttgtaaaggcatacccttttttaattcatcaacaatcatttgaagttcaatctcagaaaatccgttcatttgtcttccctcttctctatatacttatcaatatcttgaaaaaacgccgcggccgtgaatgcgatgattgcgcctattaacgtgatgtttgctttcatgtccggcctgtattcgtactggaaataaaaccagaaacctaaccccatcagcataaaaactattctcagcgccatcgaatcccccttatttgatttgaaattttgctgattcaaatgttccgatatagttccacttgccggaatcagagtagcagtccagctgaatgacataggtccctttcccggtcttattccggatcgttttcacgttgaatgatttcagaggcgttgccgttttgaagctgcctcgctgtaccagattcgtttcagtaagcccgccgccgctacgcttcttgtatacgccggccgtgtaataaagagtgcttgagccttttttctcggctttccagtccaccgttgaggcgccggccgtgtaagtcgcggcatccgtaaacacccggccgctgtacccggattcattttgccagccggaccatgctgcggaagcagacggcgcaacggccgcggctcccataagtaatacagctgatagaatgattgatttgaatagttttttcattattttccccttcctagttcacaaataattaacatttatttacaaggataatcattattttgctcgaattattactgtgttcaataaaaaacctaaggagtgtttaaaatgaatttcaaaaagactgctgttactgcactagcgattcctgtattagctttttccattagtggtatggcttccgctaaggagataactcctcaaaaaaatgaaacgcaaacaactatatctcctggtccaattaaagcctattacgatacctttgaagtgagagccgggggttctaaacaattagatgccaaatatttaggatcaggattcgcttatcattcagataatagcgctgttttcacagtagataccaatgggcttgtccgtggcaataaagctggaaatgcatatttaactatattcaaaaatggatcagtatacggtcagttacacgtatttgtctattaattttctaatagaagagcattctaatatgctcttctattttccacttcaccacctatgcagcgcccacaatgcgggcagcgggcatctgcgcggatttctaaatcaagttttttataatctcagtccgggcaatgatattcgatcatttactatccgcccattcatcaaagctgtaggggtaatcaacactttcaatgaaaccaatctccttcgccttctgacggattttcatacatccttcatagctgtaagcccatatttctttataatccctcagctcgccgcatttccctgttatgatgaattttctgaagctgttgaccagttgccacatgttgcccccatgcgaaaagccgtttgaactgccgtatcccaattcatacgggtaaacatcagcgcccgtgtaatcatcaacgaagaacagttttttcttaaatctgaaatacgctatgcgatcctttgacttgcggtagaatgtacgatgatcaatgcttgcgataagcttgatcaaatcgtttatgtcgttcattcgtttcaattgctctgctgttggcattgggttccctcctgatcaaataagctgagttgtgtgattttatagttaaatagcaataattcttcagccccgcggctttttccggatccgccgacaacctgtttgtatgcggaaaaggtttctgactcccagttcgggtagatctcgagtatcaaaggatcatcgtaataagaaagaaccactttccctttgacctgattaagcagccgggccagttcccgatgatcctcttcgttaaagccgccagcataaaaccgttcacgcccaacatatggcggatccacataaaacaaagtatccgggctatcgtatttctcgatgatgttacgaaaatccttacattcgatcatgacgcccttcatacggttggcgaaagactcgaaggcagcgcaggcgcttatgtatccgccagcagggttctgcccgctttgtgtgctatgcctccagcctgtctgcggcacttcctccacgttccccttactaatgccggagcgattcatataaaaccacctgacagcccggtcaaaatcattttgcgggtaatcttcagttttccatttctcatagagcgcccggctgtacggaatggattcgcaagcctgctgcatggcctttggatcctttctgacttgcatcaagaaattcaccacatggccgtcaatgtcgttatacacttcatgtcccatttgcggcttattcgctatgacatgagccgcgccgccgaaaggctcgacgtacaccttatgggcgggcattttatttatgatgtgatcggcgtatcgacctttgccgccaaaccagattaacggtgagcgtgccatcccttaacccccgatcaaattcggcagcacggagatagcgaagaagaaaagccccacgcatgccccgaccagccagatatttgttttatcccgtttagcgataatggtatggtcaccgatcattttcagatcgtcagaccgagcgaccagcgtcgggatgtaatccgggtgaacctttaaaagctcggccgcctgctcgacggtcatcgcttcgtccttcgtggccttcacgttccgttgtagttcgacttgtaatggcatcattttgcagcaccgcctaacatttcgggattctgatgtacgttgccgattaactcaccatacatttgaacaaaatcccaacgtattccacccgcataaaatccggcatcatcttctgaccatttaacgactagattaaacacccggccgtgtgatttataacagataatatctcccgcatatatttctttttccataagctttttgcccgtccataaatcgcggctgatcaactcgtaaccaaactcttcacaaaagacgggagacagtttgcgcgccgggcgttcttcaagctgactgatatagtacgttttcaattcaacattgcctgtttccttatgtcggaatacgtatcggatttttatgttattcattccgcagccccctccaatgcttttctggccgtttgccctccgtcgagttcgacagcaggcggacagtcttcaaattcgtttgtatacgtcgtttcattggcgtaaaattctaatgcgtttctataacgcttgttctccgcctgtagcaacttaatatcttcctgagcctgccgaaactgaatgaccgtgacatcctgctggcgctggtgctcccgattcatagcctgttgcatgattaactcttccgcgagcttttcggctgctgcttctaaagatatttgctccggtgtactggccgccgttttcgaaagggtgcaaatgtaagagccggtatataaaacctcaccttttgacaagttgattttgaattctttcatgcccgggcctcccggtctaaaagacatgttttgcatacaacccattgagctgaataatatatttttccgcagcgttcacacttgcgggcaatttcgttttgatacattttccgttcctcccccgcaggggaaaacccctgctaattgaatttatggccgatctcgtaatcacaacgagccaggccgccttttattgtttgaatgattgttttaccgtgttccggggcgtccattagatgagcagtcccttcagtgccatctaaaacgatgatgcggactttccccggctcgatgctttgctgaatagttgtttcatgattttttatttctgtcggcttgttcactctggccgccccctgtgctatgatagaagtaccagttcatatcagagcatcggggccacggcttcggtgcttttttacgttttacgacggcagccgcatcgttactccggcagatggttttaattcctcgcggtaaatgatcggatgcttttcgatgtaagctgccaattgctccggcgtcattttccacttcttaactggaccaggcttgtatcggttgatttcttcttgcatagcgataacctcctgaattgatttagttctcaagcatcaaactttctccacaaagcgttatggcaggatttccgttataatgacttccacccggggctcttcactgtaaaacttgctaactttcagatcgactacctggctatcatcccggtaaatcagatgattcagggcgtctttaactccctttacatagttgtcaacgtccggctttgttacgggacgcaggagacccttttccgcattttctctttttgtcttggaattagaaatttctttcgtcattggtctgaatactctgacatccattgccacaggtcccgtaataacttgttttggccgatactgtgacgccaccagcgcaacatattgtttaaaattctttgatttcaaaggatcacgcattttaaccttgccatttataacagatcccctcggccttccctgtgcaacaggctcgccgtaaactataaactgaatggaatccaaccgtcattacctcccgtcaatttgttcccagtgctgaatctgcttttccttgtacggcgctgtgaggatgatggccggcagcagtataaccgctttaagcactgtgcatcagctccatttgtttgattttttcctcaagcacccggatcgccggggtaaggtcctggccggccgtttgctcagcaggcccgaacacgtacatgccgccggttgctgtgaagttcgctttttccgtcattcccaatctcctaacctatggtttaattgcatccgatcgcccttgatggtcactgtgtaatctctgcacatttgatgaatgcgggagcccagcgcctcgtctatgtccaaaatttcccccgtatcaagctcggaagagattagcagaggcttatgattcaggtaccgataattcacaaccgattgaatttgttccacttgccaatccgtcgcccgcggctccccctttactggtttgaataagtcatcaatgaacagaacttcagctttccgcatagcgtcgagctttgtttccagctgatcaaagtcatttcgcagatcgcccattccctcaacgtacgggaaatacatgcagtaaattgattttttcttaatcaggttgttcatgatcgccgttaacaagtgcgtttttccgctgcccggctgcccgagcaaagcgatactgtttgaacgttttcccttgatgctctgaaaatccttatagtattccaccgcgcactcataagcgtccttgatcatatccggcttcccgtccttaatgaagtttccaaaaaggagcttttcgaattcctccgtgatgccgctggccttcataagccgggcgatctttttccgcttcacacactcgcattgcttggaaaatgtggttttccattctcgggccttatccggcaagcatactttccccgcaagataatcctcttctctgaccatttgatcaggggccaggctttccattgtcttatgctcttttctcaattggcgctcggtgtcttggtgaatacggtaaacaataatgcccttatccttgcagtcagagcactcgtattcagccttttcttctgaggcggcctgtcccgttgaagatgctgctgaccgatcccggagcttggttagaattgccttcattgccgcgtccatatcttgcgttttgcgagcttccatactgctgtttctcctttcgtctctggctgaatgggtttgagaggatggcttcaatgtaattcagattgacgttgttgcccttgaatctgaaagcctgtttcattgcctccatgactttctcttcaccgtaatcatccaccatatatccgagccgctgaacctccatcgtgccaatggtgcgggctgttttgttttcgaatagttcaaatgcgtttttcattttttcgtcaacctcctgctgtcctaaaggtattggagccgggtctatcttcttgttgtaatttccaagctgtatgtactcggcataattcaacaccgtcacaatgaaaccgcgtttttgcggcagccggtccagcttcaaatactcttgctttaccatccgatctaacgagtatttgatctgatcagaagaccagttgaagcgcttggctaaatctacaagcttaatgattgtctgcccgagctttagttcttgatctgccctgtactccgcccgtttgaataaataatcgtatattgtctcgtctcgtgaatctttaaatggcagccggggcaggaccacataccccaaaccttgcatatccatgccgctcacctacttcctttcacacagtgctgtcagagccttgaaatctacttctactaatctcagagacggctcatttgtctttaagtagtcagtcgtgtaccgggtatacaagtcctttctcaagtcgcgctgaaccgttttgaccagccagagataacaatgcgggataggaatcctgatcagctccctttccatcagctcaccaactccgaaaaatggatgatgctgttcagttgattagtggcccggcaatacttgcatttttcgcatcgctctggtttctctccgccgtgtttcacttgcaaaatccgatccatccgctgctcaatctcttcaagctctatttccagcctgccctcatcaatattgatgacagctttatcaggtggatcttcttttgaaacccctacgatcaggggctcaagccattcgctccgtccagtcatccgtttttcaatctctgcgtaaagcgccatctgagcgatgtatccgtatgcctcaacaaaagagcaatatcctatttccgggtcccaaactttctcccgcaatgaccgcgctgttttcagatcggagaaacggccgccagctgggttgtatacgtccagctttcctttccacggaacaccgaacaattcagcagttacgatgacttccttttctccttgaagaacaaacatacagagatcatcattttgaatcgcctcaatcatcagatcagctaactgatactgcttgtacagctggcccttttgtgtaaaaagtgatggggtgttctttttaaattcatcaaaagcctgttcaccctcaagccaggcatgaacgtattggccgaagaggagcgcctccgatgtgggcggcgtccattctccgttcaactttgccatcgtggcagcctcgcattgcaaaaagcttttatattgagaatttgacatgtagtgtctatcaatctcgttagagtaataattcttcttgttcagcgccggtatccgcattagcaggatcacccgccttttctttactatcagcaggcttgtcagcttgctctttcagctttttgaattcttcttcagcctttgatttagtcgcgctagtggccttcacattgaagtaatcctctttctttgccatcccatcacgcagggccgtgtaaatacgaccaattttcaggaaatcttgctcagtgaaggcatcaacattactgccgatgtactcctgaatcatttccttagtgatgccaaactcttttttaaaaagggagaaggcacttctgagtcggtcttccagtggttccttatgtccactaatcaatgttttttgacacatatctaccgccgcatcaacgatgtcgcccggaatcactccaagtatgcaagcacgaacccggcgggctccttgattggcaaccatttcgtaaatatcccttggatcatcaagtttggtaatggcgccccgtgccttccgttcatgcttcacagtgaaaattttggtttgccgggtattcgtttcaagatcccaagcgtaagccatgacagatgattcaccggccttttgttccaactccataattccgtaatcaatgttcccccagttctgtgccaaggcctcagccagccggatggatgggccggaaacctttgtgccgccgcgcggatattcatataccgcattctcagccaatagcctccgctcgcatgcttttttaatccggtcaaaagccgcgtatacgtcccgtgggaatttctttgcgataaccattgccgcttgtacttcttgagcctgtcggcttaccatcgcttccatagtcacgccagtagcctgctggggcgccggcatgtaatctgagtaatccacctgtgataatccattcattgtgcttctgccacctttcttttatatgcttccgttccaagccgctgccattcccgatagtgatccattgaagggaaactaaactgcgctttaccgtttttggagaatacaattgagccgccgacctgccttaaacgtcgctgatcctccgcacgctcactgaatgccactttaactgctttagccatgtataaaacctccattgttttttatggggcgttttggtataataggaatacaatcaattatcaaaacgccttacctagtccactctgccaagtgggcttttttattgctcatttttaaattcaaaaccaagatgctccttcagataccgctcaaggttttccctcaagatgatttcaccctcagcactatctatcacgtaatcatcgaaagccgttacttcatccccaaagtaatccttttgcgtgtccggctcagtcagtttgtcatgccagttgttcaagaccatcggattttcaatattcattgtgaacacctacttacaacactcaggtgaatcccgcgggccgccatatttaagacagtttgatgtaagcgccctttattcgtcagccggtttatatcctctgtaagaaccttgatgctccctgcaagactgatagcttcttcataatcgccatcccgcaacgcctccgcaagcatgatagagagcctttccgccgactcgattttcctttttgctgaatctgcatctgctttaagaaactgattgattttcataccagcaccgcctgcctttcttctgttttcgccattgcaacctgactcattagcgctttccgcgtccacctttcggccagttccttcatgttcagtccatgactacgggccagcgaatatatcagcgttttatttgctgggatcagatcaaaaatctgctttatatcggccatgggcagttcttcaggttgtcggcctggcctatcgtttgccaaccagcgcgctaaatgccttgttgcttgtaatgcttcttcaagctggtgaatcatattgattaccgccgcgcttgcactctcgttaagtgctggatcaattggcgccgccgtcgtcgggtgcaatttgaagagataatgtaccagatcaatatgttcgtatgcctcgcacgcctcaaaccacttaatgcataattccggggtaagcttactgaatccattttcaacgtccgaaacatatcgctgatcctttccccctatcaaattaccgatctgatactgtgcaagtcctgccgctttgcggacactacgcatgatccggggtagattatgcaaattgtatgggttgttctccatatgtttgcctcctgatatatccagttgttcactggtaaaatttaattaatgaagggacaagctagtccttttctcgaacattaatctccccaaatttgtggagattgtttcaagctgtttctgatgaaatgaatttattcacaaaataaatctgaccttttcccgtaacctttggcgttcgggtagttctaattgaaccatcagggttattcattgttctcttcttaatttcaaagagacccaaatccatacttcgctgtgttggtagattgaaagactcgcctgtcttacgaattaaataaccattatcacggagccattgaaataacttgttaggtccaatctttacgccgttctgttgaatgattttcgctaactcgccaacaagcacagatgattcagatgcttccacggcttcggcgaaaagagcttttggcttcatagattcaatttgcttattttgctcctttagtgcgtgaagagttgttttgaaaaataatttggtattttcgtctgcgttggacaaatacgtctgaatgaactgttcatcatttgcgacatatcccccggtttttctgattgtgggtataacttcaaaggctaaccaatcttgaaattgttcggcaatttgattagatgctctaaaagccagcttgtacaccaatggttcaggaataaaatcacctttctctacttctggaaagttatccggaaggtaagtattcacacggctccatcggattgttacgttgccacttttggcaacggtagtgaggcctaagttccgagcaacttgctcggcatcaaaaaggatttgatcattctcaattttggctgcaacttcgaaaatttcatttttgaatgtttgtaaattattcatgccgaagctcctttctgatagtatgcggtgttctcagcaacccaacgcgtgttgctctcaatccatttaaaaagcaaagtcgtagggatttttttgccacattcttcgttaaccggaaaatccggacgggccatcagttccgccattttagtgggaccgcaccgcagcacctccatcgcttcagttctcgtcaagatgtgaggaagctcgttcaaagagctgagccgctctaccagcatgtctgttgctctatcagcaattttggcagctatctgttcaatgaatttctcatcgtattgcatagtgaacatataaaaaacctcctttacaatgagctttataatctctcactttcatgtggtaaaatatgcatggaaggtggtgagatttaatggcttctactaaggtttacgcttgcctttgtggtgaatgggttgacttgactagtgatccggactgcaaaataggtgaatctatgtcttctccatacatatggtgggaagaaggtgcttcaatttggagccctaattctaaagaagagcacacgatgtatcagcaagattacgttaatatttattacaaaaatgctgaatatcgcattcacccaatgtttatccaaatcaagtattcatcctaaattcacgtttaaggttagcttctaacagttctgggtcgtcaaactgcaatttggcggctttagaactgaacagtacatcgacatgttgtttaacacggctccactcggattgggacataccattcaacaaatttttaatttgttccagctttttttgatccataacttcgacctcctatactgtttttttgtaactttcattcctaagcagttttctcgttaccctttttgtgtaacttttcattaaaaaaaagctcatcgacttcttcattcagtaactcggatatttggtgtgctttttcaagacttggctttgtacgccccatttctatatttgcataaccgcttgcgtatctatagccaagcttttttgccataaaagtttgggtctttccttgagaaagtcttgtagcccgtaatttttctagcactattaactcaccaccttactcttttcgtgtaactcgttaaatacataataatatacacaataagggtaagtcaacatatttttattctttttgtgtaagtaattatctcttgtgtgtaaaccgtgttaaaatttacacaccaaataaaaaaaggtgtataataatggataatataacagggaaaatcttaactgaattaagagaaaagaaaggctggagcaaatctttcgtcgcaaaaaaattaggtattaaaacaatgtctacatatgcgaactgggaatacggtttaaggaaaccagatggagaaatgctcgttagacttgcaagtttgtatggtgtaacaactgattatctcctaactggcaaagaacctacttttaataatgacctttttgatgatcctgatctacagatcgcctttagagaagcgagtgacttctcagaagaaagacaaaaacaagcaattgattttataaagtacctcaaagagaaagaagaacgtgaaggccgtaagcctaaaaagtaactaactgccgaaacctttatttatattattgttattatgttatttctgtttactaataagatcaggattggatcgggattagaaccgaactggatcggaaaagaatttttcaccagtaggttgaagccaattatatcaagggaaatagaattctttctcatctggattgcatctggattcaaacgggatctgatcagaaaaaaatatactcaagtgtattacttataaaggggaaattaaatttgtcttttttgatggaaaatggcgaaatctataactgtcagtttaaaaaacgcatgaaggcttctaaaaatttcttgaaaacttatgaagcagctaaacctctgattgatgaaagaaatgaaacaattcatgaactcgtttgcggaactatgaagagtgacgcgacatgggggcattttattgctacagaaaatcaagtatatttcattgtcttgaaaaagaaaaaaccaattttaaagaattggccctataaagaaataattaaaattactgccagtcgcaagccattaattggacataagattgattttaaaacagccgaagaagacttaaacatcaattcaatatcagaaggtgatattgacggctttatcaaatatgttgaatcaaaaatctctggcaatgaggaaagatacgaaagtgaaaaagaggatttaaagaaagaaactaaagaatactattttaaatcagcaaaaacaacaatcacacttgatggaaactatataagagtagcaagaaaaggcgctgttaacactatcacacgagggtatagtggggagaaatcttatagaatcagtgaactgtccgggcttcaaataaaaaaacctggattagtaacctcaggctattttcaatttttaacgccagctgctaatgaaacaagtggactctgggacgcaatacaagacgataactccttcacttttggcgcaaatgaactgcctatggttttagaaattcaaaaatacatagaagaacatcagtctattccagctccaacaataccaccagctcctgcccctactgtatctgcagctgatgaattgaaaaaatataaagaattgttggatatggatgctatcactcaagaagaatatgaaattaaaaagaaacagctattgaatttatgacagcccttcttcctcgggcttttctttcacaccaaaaacagaacatacattccctacatggtggtgtttttaatgtcaatccagttatcgtatcttgaagaagaagtgaaaaaaatctattacaaattaaatattgagactcctgaagacattgatttagaaaggattgccgcggcatttcgtatctggctgcattatgagcaaagagaaagctgcatgtttcaaattaacggtgagtatagcgttgtccttgatgctcgagcctctccgcaagaacagtggcaagactttgttcatgagctagggcatgtgattaaacattgcggaaaccagttcaacatgaatcgtatgtttcgccagttgcaagagtatcaggctaatagctttatgtatcatttctgtgtacctagttttatgcttgaaaagatttcgttgccacgcatgaaatcagaggttataaaattaataggtgatacctttaatgttacatatcaatttgctgctaaacggctcgatatgtatacaagaaaacagttctcattcttgatgtataaacagctctttaaaactattcattgaaaaattggggtgacaaaatgtatacagaggaattgatcaagggtaaaaaatggctggctgttggtgacggacctcgtgatcccgttaccggtaaacgcaaacaaattgcgcggcgtggcaaaacaaaaaaagaagctgaacaaagagttagagatgctattgatgccttaaaagaagatggcattgatgaatcagttgttaaaaaaatgactttcgaaaagcttgctgccgaatggttgaacgaatatgctctcacaggaaagaaaaaagcaactctgcgtattcgaaggaaagaaattaacatcttaaaccggtatatcgctaaaatcaatatcgctcaggtaacaggaagaaaatatcaaaaaatactcaacgatctcactgatcaagaatatgcccgtaccaccattagtggtgtgcatacgacagccggaatgatttttaaatacgctgtaaaggtgaagcttttaaaagataatccagtggctggcgctgtagttcctaaaaagagaatgacagtagaagatattgaaagtagtaaaatagagcaaaaatatcttgaaagggaagaacttgaagagttcctcttagcagtaaaagtccatggtttggaaatggaccttgaacgattttacttgctcgcttttacaggcatgcgttcaggggaaatgtgcgccctcaaacttcctgatataaattttgaaacaaaagagctgcgtatcactaaaaccatatattccgaagataacaatatgagaaattatgaattaactccgccgaaaacagccggatcggtgcgaactatcactctcgacgatcagataatagatatattgaaggcacatgtaaccaaacaaaagaagttgcgcctacagtccaggattgatccaagcgaataccacgacggtaatttcctatttgctcgtgagaatggctatccctttttaccaaaaaatatcattgtaagaatggaaagaatactggaaaaaacatcaattaaaaaacatgctactccccatatatttagacacacgtatatcagcatgctggccgaggcaaaagttgacttgccaactgtaatggaaagagttgggcatgacgacatgaaaacaacgatgaagatttatactcatgtaaccaaaaaaatgaaagaggatgcctcccacaaagtccagcagacttttggaaacatcctcaatttcgggatttcataaagaaatgttatttttttgttattttttcggttaattggggtgatgaaaaacggtcaaacccttggtgtatcaagggttttttccgtttgattacatcatgccgcccataccgcccatgccgcccatgtcaggcattcctgcgccgccggcgttttcttccggtttgtcagcgacaacggcttcagttgttaagagcattgctgctacagaagctgcgttttgcagggctgaacgtgtaacttttgtcgggtcaacgatacctttttcgatcatgtttacccattcgccggttgcagcgttgaagcctacgccgattttttcatttttcaggcgctcaacgatgacagatccttcaagtcctgcattgtgtgcgatttgacggatcggctcttcaagcgcgcgaagcacgatgttgatacctgtttgcgcatcgccttcagcttccactgcagcgactttgttgtatacattgacaagcgctgtaccaccgccggatacgataccttcttcaacagctgcgcgagttgagttgagggcgtcttcgatgcgaagtttacgctctttcagctcagtttcagtcgcagcgccgactttgatgacagctacgccgccggcaagtttcgcaagacgctcttgtaatttttctctgtcgaattcagaagttgtttcttccacttgagcgcggatttggttgacgcgagctgcgattttttcagtgtcgccggcgccttctacgattgttgtgttttctttcgttactacaactttagaagcgcgtcccaattgtccgatttcagtagatttcaggtcaaggcctaagtcttctgtgattacttctccgcctgtaagaacagagatgtcttcaagcattgctttacggcggtcaccgaagccaggagctttaacggcaacagcgttgaatgtgccgcgaagtttgttgacaacgagtgtagcaagagcttcaccttcaacatcttcagcgatcagaagcaatggtttgccttgctgtacaacttgctcaagcacaggaaggatttcttgaatgtttgtgatttttttgtctgtgattaagatgtaaggattgtcaagaaccgcttccatcttatcagagtcagtcaccatgtaaggagacgcatatccgcggtcgaattgcataccttccacaacttcaagctcagttgtgaagcctttagactcttcgattgtgatgacgccgtcgtttcctacgcgctccattgcttcagcgataaggcttccgacttcctcatcagcagcagagatcgcagcaacctgagcgatagactctttgccttcgatcggcttagaaatttcttttaagttttcgattgccacggttacggcttgttccatacctttacgtacgccgacagggttagctcccgcagttacgtttttcaggccttcgcggatcatagcctgcgcaagtacagtcgcagtcgtcgtaccgtcaccggcaacgtcgtttgttttgctggctacttcagctacaagcttcgcacccatgttttcaaacgcgtcttcaagttcaatttcttttgcgattgtcacaccgtcatttgtaattaacggagaaccgaattttttctccagaaccacgttacgtccttttggccctaaagttacttttacagcgtcagcaagcgcatcgacaccgcgaagcatagcgcggcgtgcttcttcactaaacttaatatcttttgccatgttaacgaaacctcctcgaatttttaaaaatatttatttgcttagccgattacagctaaaatgtcgctttcacgtaagattaagtattcagtaccttcgtatttcacttcagtaccggcgtattttgagaagataatgcggtcgccctcttttacttctaaagcaacgcgctctccgctttccaacacgcgacctgaaccggctgccacgattttgccttcttgcggcttttcttttgcagaatccggtaatacgattccgctggcagttttttcttcagattctacgagttcaatgacaacgcgatcacctaatggctttaacaatgtaataacctcctcaatagtatgaatatgtaattttagcactcagctctaaagagtgctaacacagttattataataaagaatctcacttccaatttcaagtcataagaataaaaaattttcacgcttacatgattctctctcgcactgattttctccttttttcacgtcaagttcacttgtgttacaataagaacaaataagttgattttataggataaaggagtacatatcatttgagaaaacagtattggtatatcattttgacatatgttatcatgcagctttccgcattgatcggcattcctttaatgtacaaattcggctatgcgggcgggcaccctacgaatgcgaatctcaccatggctcaggggatttattccgtcgtaagcttttttatctgcctgattatcgttctcttgattttgagaaccgcgccgaaacagacattaagaaacgggaagaaagcatccgccggcatgtccgttctctgggcggtcgcgggaatatggctcgctttattttctcagggaatcgccgggatgattgagcagtatgtctttcatgtgggcagcggttccgaaaacacgaaagccattcttaacattattaaagccatgccgctcatgattatcgtttcttctatcgtcgggccgattcttgaagaaatcattttccggaagatcatcttcggtgtattatatgaaaaaacgaatttctttatcgccggactgatcagttccgtcattttcggcattgtgcatcaagacctcacgcacctgctgctgtatacggccatgggctttacctttgcgttcttgtatgtgcagacgaaacggattattgtgccgatattcgcccatgtcatgatgaataccattgtcgtggtcatgcagctcggccccgcccaaaaatatattgaacagcatagtgagcaaatgcaattaattattggaggattgtttgtatgaggaacccaatgacttggggcttgatttatttcgcagtcggctgtatctttacgtatttggccgcaagctctccgggaagcatgtggtctttttattccatactgctgatggttttcgccgcttataatatcagcatctcgtttaaaatgttcgccttctcatttaaagtgaagaaaaaccaaaaataataaaagaaaagccatttctcatcattgagaaatggctttttttatgctgatacgtcctggtcagattcactgccggtctgccttttccgatacgccgcttttgaaatcaggatactgatctcgtataaaatgcaaagcggaatggtaatcatcaagtgagacagcagctcaggcggcgcaatcatcgcggcgatcacgagcagcacaaaatatgcgtacttcctgatcttcgataaaaacctcggcgtgataacaccgagtctcgttaaaaacatgatcagcaccggcatctgaaacagcagcccgaacggaatcgtcagctgcagcagaaaatgaaagtactcggtaatcccgattacctggttgacatccaggtcattcgagacccgcttcataaaatcaacgaccagcggaaataaaatataataagaaaacgacacaccgccgacaaacagcacgatcgaaatcggaatatagctgagtgttactttgcgctccttctcatacagacccgggctgacaaacgcccaaatctgatagagaataatcggcgaagtcaaaatgatgccgatgataaacgcgaactgcaaaaagataaacagcggatccgtcaggttaaaagcattaagggtgagctcttttacttcatcggctttttgaagatacacaatgataggttttgccagaaaaaagccggcaataaagaaaaccgtaaaggataacgccacaatcagcaatcgtttccgaagttcggcaatatgctccacaagcgtcatttgattcactctcatacgcgtcatcctatcttactgttcttctttctttttttcctcttcttcaccggctaatcccttagtagcgttcttaaattcacgaagcgtgtcccccgccgcttttcctaattcgggaagcttcttcggaccgaaaataatcaccgccaccacaccgataaccgccaggcttccaggaccgatcatgtgcagctcctcctttcgctattcaatttcttccaaaacagaataatgctttaagaaataaaccaatgattgaagctctactgctaaatctatatgatgaattcgaatgtgatccggcacattcaaacgggccggcgtaaagttaaggattcccttgattccgagtgacacgagccggtcggtgattgactgggcggcaaccgccggaacggtaagaatcgccacgggttcatcctttatgtgaagctctaaatcattaagatcaaagacaggcacaccgcctacctcagttcctattttactctgattcacatcaaaagccatagatatttttgtgttattattttttgtgaaattatagtgaagaaacgccgtccctaaatttccgacaccgatcaaaatgacgttcgtcgtttcatcctgatccagtgtttttctgaaaaatgacagcaggtaatccacattatagccgtatccttttttgccgagcgccccgaaataggaaaaatcccggcggatcgtggccgaatcgacttttaccgcatcgctcagttcagccgatgaaacgcgctgctttcctgacgcgtgtaaattctttaaaaagcgataataaagcggcagccgttttgccgtcgcctgtggaatttttgattgatccttgttcatgattggtcctccactttatactcagatgcatctcttttaaaatcaccgtttttgcctcctgttttttccatgaggcaggtcgggccgatgaccattcctttatccagcgccttgcacatgtcatacacggtcaaagcgcagactgaagcggaagttagcgcttccatttccacacctgtactccctttcgtttttacgcttgcctgtatatgaagaacggcttcggaatccttttcctcccagccgaatgaaatgtcgacgctgcttaaagaaagcgggtggcacatcgggataatcgctgacgtctgctttgcggccataattcctgccacctgtgcgacagccagcacgtctccttttccgatctcgcggtttttgattctgctgtacacgtcatgcttcatgtgtacgctggatatcgcagcggcagtacggactgttgaagatttatcgcttatatccaccatgcgggcacggccttcttcattaaaatgagaaaatccattcatatttaaactctccttacttctgatcatacactattttctccctgatgtcttatcctataatgttccaattctgatgtattgtttgctgacagcaggttgataagctacacttaacttattataacagaggtgaaataatatgatgatcttacaaattaatcagctatccaaatcttttggcgctgatcctattttaaacaatataaagcttgaagtcagatctcgggatcgcatcgccatagtaggcagaaacggagccggcaaatcaactctccttaaaattatcgcaggtcacctttcatatgaaaagggtgaattaatcaaaccgaaagaattaacgatgggatatcttgcccagcacacaggcttggaatcccagcttaccataaaagaagaactgctgagcgtttttgatttcctgaaagcaatggaaaaagagatgcgctctattgaagaaaagatggccacggccgccccgcggagcttgaaacgctgatgaaaacctatgacaggcttcagcaggatttcaaggataaaggcggctatcaatatgaagcggacgtccgatctatccttcacggactcggcttcggaaaatttgacgattccgtgaaagtgcaaagcctgagcggcggtcagaaaacaaggcttgcgctcggaaaactgctgctgacccagcctgatctgcttattctggatgaaccgacgaaccatctcgacatcgatacgcttacatggcttgagcattatttacagggatattcaggcgcaatcctgatcgtttcccacgacagatactttcttgataaagtcgtcagccaagtgtacgaggtctcacggacagaaagcaaaaaatacctcggcaactacagcgcctatttagaacaaaaagctgagcagtatgagaaagacctgaagctgtatgaaaaacagcaggacgaaatcgccaagcttcaagattttgtcgaccgcaatctggccagagcttctacaacgaaaagagcccaaagcagacgaaaacagcttgaacggatggacgtcatggcaaagccgctcggggatgagaaatccgccgccttccgttttgacattacaaaacagagcggaaacgacgtcctgcgcgtacaggatctttccatcagctatgacggccagccgccgctcttgaaaaacctgaccttcggcattacaagaggcgaaagcgccgccctcgtcggaccgaacggaatcggcaaatcaaccttgctgaaaacgattatgaatacaatcagtccggaatccgggtcgatcacgtacggttccaatgtcacaatcggctattacgatcaggagcaggctgaactgacatcgtccaaacgcgtgctggacgagctgtgggatgaatatccggacatgccggaaaaagaaatcagaacatgcctcggcaactttctgttcagcggagacgatgtcctgaaaccggtccgttcgttaagcggcggggagaaagcaagagtcgcgcttgccaagctgatgcttcaaaaagcaaactttctcatccttgatgagccgacaaaccaccttgacctggacagtaaagaggtgctggaaaacgccctgatcgactacccgggaacactgttatttgtatcgcatgaccgctactttattaacaggatcgccacaagagtgctggagctgtcacctgatcatgcagaagaatatttgggagactatgattattacaccgagaaaaaagcacagcagctggaactggaagaaatgaagcggcaggaaaaggagcagactcagcctgccggcaaggtcaaacaggatacgaaaagaacttacgaggaagaaaaagaatggaagaagaaagaacggcagcgcctgagacgcattgaagaaatcgaagcggccgtctcatccgccgaagagaaaatcagtgccaatgaggagctgctgtgcgatcctgacgtgtatcaggatcatgaaaaagtacagaccattcacgcggagaatgaagcccagaatcaaaagctcgaaaacttattagcagaatgggaggaactctcctcagaagaatagaaaaagtcaagcacctctttaaggggtgcttttttatccacagctatcctccttgtcagccatttaagtaagcgttttatacacactatccacaaaattttctgactttatccactttactaacaactttcagtcccttatccagactggatttctgaatatattcacaatcctgtggatatgttagaattatctgttaataagtaaaaaaaagcctcacgttttacaacgtgagacgatcaaaggatgttaattccaaaccgggctgtccgttcatatcgtacgagccccggatccccttttcaaaagcaacggttccggcagccgcaatcatcgctgcattgtccgtgcataaagaaagcggcgggatgacaagctcgggatctcccgaatggctgaattcctgctgcagtgcggctctcaaccctttgttagcggctacgccccctgcaagcagcacttgtttaaccctgtattctttcgcggccttagaggtttttgccgtcagtacatcaatgacactctgctgaaagcttgcggcaagatcctccggaggaatcacctcatttttttgcgaggcgttatgaagcgtgttaatcacggctgatttcaggccgctgaagctgaaattgtaagacccttcttccagccacgcacgcggaagcggaatggaatccgttcccgcagcagccagcttatcaatctgcggccctcccggataaggaagccccatcgttcttgccactttgtcgtaagcttcgcctgcggcatcatccagcgtttcaccgataacctcgaatgaaccgtgttctttcatataaaccaattccgtatgtccgcctgacacaaccaaagcaagcgccgggaactgaagctctcctatcagcctgtttgcataaatatggcccgcaatgtgatggacgccgactaacggtatttgatgggcaaagcttaacgcctttgccgcattgaccccgattaacagggctccgacaagtccgggtccttccgttacggcaatcgcatcaagatcatcaaagcccatctccgcctttgaaagagcttcctcaatcacaagggtaatctgctccacatgatgtctggacgctatttcaggcacgaccccgccgaaacgtttatggctttcaatttgagaagcgacaacgtttgaaatgatgtcttttccgttttttacgactgaggccgcagtttcatcacagcttgtttcgattcctaatacataaatatcttgtttttcactcatgtaatgtcacccacattaataacgcatcttccccgttatctgtatagtattgttttctgattcctccggcctgaagaccgaatttcttatataaggattgggcgggatgatttgagaccctgacttcgagagagagccttcttgcctttttttctctgcacaattctatcgcagagcgaaacagcgcttctcccaacgattggccccgatattccggcttaatggctatgttcgtaatctgcgcgtcatctataataatccagattccgcaataccccgccagacagccgtccttttcaatgacaaggtagtgggcatacggattttccaaaagctcatgataaaatgaatccttcgtccacggagaagtaaaggatgctgtttcaatttcataaatttgatcaatatcttccggccgcatgcttcgaatcgccgttttcgttttcatccctatcaccctatttttgagattccatccatttcgcttcagcctctgccagacgcaaataatccggaacaaggctgtggacatccgcttcttctttttccaagcctaaaaacgccagctctgacggccgcggattatgctgtgcagccgttcctatcactgcttgatttgtcagcccatgcagaatggtttcttcatgaatggctgtatcatgccctaaaaataaaaccggagacgctttttctttcagcatgtcgagccaatcagtcaaaagcacattctgatcaggaagaacggattgtaagcggccgtcctgatattcataaagtcccgtatatacctgtccgcgccgggcatcaaataacgggcagatcagtccttgaaagtgccgtccgttagccgccagcacctccaggctcgagacagcggaaaccggaagcttcagcgaccatgccaatgtttttgccagcgtcacaccgattctgacacctgtgtacgatccaggtcctttcgccaccgctattttcgtaaggtcctgcggtgttaggccgcaatccttcagcaatgaattgacagcaggcatcgcccgcacggaatgattcttttttaaatatgtaatatactccgccatcaccgttttctctcgaacgagcgcggcacccagcgtgtaatttgacgtatcaattgccagtattgtcatgtttatttatctcctcacaaagcgtttcataccgtgttccgcaagccgtaaaggtaatgtcccttgcctcatcaccggctctcttgatgacgatctgcagccgttcagcaggcagctgatcctgaattaaatgagcccattcaattaaacagacgccttgtccctcaaaatattcttcaagccctaagtcttcgctttcatcctccatacgatacacgtccatatgatatagaggaatcgaaccgtcatggtattcttttataattgtaaaagtcgggctgtttaccactctcgtgattcccagtccttcggcaaaaccctttgtaaaagtcgtttttcccgcgcctaagtcgccttccagtgtcaaaatgtctcccggctttgccaaagaagcggcaagcttggctacggctttcgtttcttcggggtttttcgttctccattgtaatgtcttcaaagtgagtcacccgtcttatttaaaatgattgtatccttttttctcaaggacgatttgtctctgatcattggctgtcaaaagaacacatgcttccttccgttcagataccgcccctatcttcgcaatcggaatgcccgattgagtgcagtaatcaagcagagaggtccactcttgctgagaaaccgttccaaccaattcaaaatcttcaccgccgaataacacccatttcttccactcagaatctgcctcaggcaaatccggatgcaccggcagaagttgttcttcaatttctatcgtaactgaacttgccgcagctatttcatgcagctcactggccaatccgtcactgatatcattcagagccgcgcgctgaagctgagagcagaagcggccgacttgaactctcggaacgggccgtttatgtttttggataaaataatcactcgtatgaaaagcagaaggatgtgtttctcccaacaaaagagacagtcctgctgcggacgagccgatatcccccgtaacaaacacaacatccccgggtcttgccgagcttcgcagacaagcgcaatccttctcaacttctccgatgacagtaacggtaattacggcttgaccggaagcggagacggtatctcccccgatcaaatccatttgatatagtttcgccagttccgccattccttcatacattgcctggacgtcagctttctgccagcaagaaggaaccgctagagacaccaaataaaacttcggaatgcctcccatcgccgccacgtcactaatgttaacagcaagcgccttataaccgatatcatgaggagaggaatactctaatttaaaatggacattctccaccattgtatcaaggcagacaatttgctgcatgtggggtgacgctgtataaaccgcaccatcatcaccgatccctacatcgacggaaggatgataatgcgaatgcggtgtaatactgtgaatcaaatcaaactcatccatatatctcccgtcttcctttctgacgctcttgtgaaatacagctctttctagtgtatcggattatgtttcaatatccaagactttaacgatataaaagaaagcttggttagataccaagctgccagcattaaaagaaaacacaaaaaaaacgaaaacatgatcgtttcgtttacaataaaaatggcggtccggacgggactcgaacccgcgacctcctgcgtgacaggcaggcattctaaccaactgaactaccggaccatttaatttttggttgcgggggcaggatttgaacctgcgaccttcgggttatgagcccgacgagctaccgaactgctccaccccgcgatgataaaattttagaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaatatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattataatggagcgggtgatgagaatcgaactcacgacatcagcttggaaggctgaggttttaccactaaactacacccgcatttgaattggcgcgcccgagaggagtcgaacccctaaccttttgatccgtagtcaaacgctctatccaattgagctacgggcgcttatcaggcgacttaactatcatactaccaatcagttatgatgtcaagtgttattttatttcttttcgaagtcttttttctcgacctcatttattatacacgctttcgagaatttgtaaagtcttttttaaaaagatcattttctcatttgtcgttatcgctttgttcatcagcgacgtttaataatataccacgcactttaaattaggtcaacacttttacgaaactttttttccgcttattattcccttctatataataaataaaaagcaggattcccaggaaccccgcgtctattcagattacccgctcacctcggcttctgcgctattacgatctgttttttcataggtacggaagttttgttcaagctgttcgagcgaaagacctttcgtttccggaaggaaccttttcacaaatataacggacgctatccctaacaggacaaaaatgaagaaggttgcagacaatccgatgtttgcgagcatgaccggaaaagttaaaccaacaatgaagttcacgatccagaggcagaagacagtcacccccataccaagcccccgcaatcgcagcgggaatatctccgacagcatcagccaggtcaccggagagacagccccctgctgaaacgcaaggaaagtgactgttaatgaaagaaccacataaggaagagcaggcgatcctttcagcacgacagacagaactccgatcaaaagcagcaccgcagtcgttccgatcagccccgtcatcagcatcgggcggcggccgactttgccgagaagccatattcccacaaaagtcgcgagcaccgaaatcacaccgttagcgatattgccgattaatgcggcttttgtctcaaaaccggcatcttttaaaatttgagttccataatacataattgaattcacgccggtgagctgctgcactaccgcaattccgatcccgataaacacaatgcggcgcacccacggaacggcaagatccttaaaggtcgcctgctccatctgagcttccttatgaaaggcagattcaatctcagcgagctcagacttcgctttctcttcattccttattcgccggagaacgtgcaaagcatcttcttttcttcctttagaaaccagccagcgcggactttcaggaactttcagcataccgaaaaacaagaataccgccggaagggccgcgataacgagcatataacgccaagcgtgagaggtatcaccaagcacattgccgatgatagcattacacgtgaaggcaagcagctggcccgttacaatcatcaattcattttgggtaaccattctccctcggctttccgccggcgacatttcagccaaatatgccggaacggttacggatgctcccccgacggcaagccccagcagaaaacgggagatgatcataaccgatacgttaggcgccagtgtacatccaagcgtcgctataaagaacaaaacggcaaggataaggatatttttacgtctgccgttatagtccgacaatctccctccgaaaaccgcgccgatcgcagcgcccaagagcagggagctcgccaccatcccttcagtcaaagcggtaagattaagctggtcagcttccgccataaacggcagcgccccattaatcacaccggtatcgtagccgaaaagaagccccccgaatgtcgatactaaaatgatggttctcaaaaatgaatgctggctgctatttttattcatcttcaaatcctcctagtttttacacagagataatatcggaatattcagttatcaatatttacacctctaacgtctgcatacaaggtctgaccgtccaaaacagttatataagaagaaaatgttccgaaagcgttatcatttatagtgattattcgctctccccctctcgtcatattgttattttatagttactttgtagtgaagttataatgatattattggtacttatgttaatatcataattttaaaagcgctttcagtcaataaatatttcagaaaattttataactcacctttatatcacctatatataatcaattttcgttttatatcaatttatttccataatatactcaattaattacccctattataatcaataattgattacatattgaaaacccccaactgctgattgggggtttttgttttattcttcgtttattgtaacaatcgttctccctctcgcttctccttttaaaagggcaggaagcgtatccggcagctcttcaagtgtaatttccttttgaataaaggcctccagatctgcaggcttgaagtcatcagctaaacgctgccatgttttctttcttgtctccatcggacagaatacggaatcaattcccaagagactgacgccgcgcaatataaacggaaagactgtagccgggagtttcgttcccgctgtcagtccgctcacagcaactgatccgccgtactgaatctgactgagaactgaagcaagcggctcacctccgaccggatcgacggccgctgcccatttttgtttttgcattggttttaacgtgccgttatacacttcgtcgcggtgaatgaccgtctttgctccgaggctcttcaaatacccgctttcttcttcttttcccgtactggcctcgacctcataacctaaggttgaaagaatggagacggcaaagcttccgacgccccctgtcgctcccgtcaccagcacctttcctttttcaggagcggcatggttttcttcaagacgctggacggacaatgcggcagtgaagccggcggttccgatcgtcatggcttctttaagtgtcagaccttcaggcagcggcacgatccaatctgccggaatgcgggccagcccgctatagccgccaaaatgggaaacgcctatgccgtagcttgtcgcaatgactttgtccccttctttaaaacgggcgtcatctgaagaaacgacgattcccgctaaatcaattcccggcacgaaaggatacgaggttacgatcttgccgtcaggaatggcagccaagctgtctttataattcacccctgagtagcaaaccttaatcagcacttcaccctcgggaaggtcctgaaccgccagctcccgtacgctgactgaaaaccggtcttcacgctgatcgactactaacgctttaaattgatctgtcatcactacgtctccttaaaatgaattgaatggctttggaaaagcataaaataagtttgatttgttttcaaatgtcctgccctgtgtagtatgatcaaaagtaaaaacagcgaaagagtggttacgcatcatgtctgataaacaaaacaaagataacaaaaacaacaacagcaatcagccattaccggacattattcataccgccgttttcaaggcgccgatacaagttgtctgggatacggtctctacggcggacggcctgtctctctggtttatgccgaatgatttcacgcctcaagaagacagtgagtttcagctggaatctccgttcggtccgtctccgtgcaagctgctggatattgaagcgccgtaccgcctttctttttcgtgggatacggaaggctggatcgtctcttttgtcttaaaggaaacggaaagcggagatacggaattcactctcattcacggcggatggaaagagccggaagccgtcatcaataaagtcaatcggaaaagctccgagattcacagtacgatggatcaaggatggaacgggcttgtcaacacgaaacttcgcggggcggttgaggcttaacacaaaaggacggacacgctttccgtcctttttttgatgccgatacataaaaactgactttgcaaagacactaacagaagaaccgaaaacttctttcagggggcgctgtttatgtattattacaaagaagagctgatcaatatcattaaaccggacaagccggacccggccgcggccaaggtgcttcaggaaattttaggcgggcattacggggaaatgcggacgatgatgcaatactttttccaaagctctaatttcagaggaaaagaaaagcagttccgcgacctgcttcgcggcgtatttttagaagaaattgcacacgttgagctcgtccagcatacgattaatgcgctgctggatgaaagcggcgctgagggcgccggaaatcaggcagcagatcaggcgccgctagacgaagcggttaaacacgccaatccgcaccattatattatcggggcgcaaagttctcttcctgccgatgcaagcggcaatccatggaacgggtcttgggtatacaaccacgggaatctgatttccgatctattggacaatgtcgtgctggaatcaaccggcgtgctgcaaaagacgcgcatttatgaaatgagctcaaaccagacgttcagagaaacactcggttttctgatcgtccgtgacaacgcccatcaaaatgcatttacaaaagcgctggaaacactgggtgtcgaatggggcaaattatttcccgtgccgaattatgatattgaaaaatacccggaatgccggaaattcgttgaaatgggttatcataatacccaatttaatttcagactggatccgacacggatcggagaaattctgcagggaacgacgccgagccgaaacggcggcgaattaagtgtgtcagagcctcctaaaggtttccccgtgccggaacttcccgagcttccgaatgagcacagccccggactgaaagatatgaacttgtaacaaaaaacgcctgtttcgggcgttttttgtttttctgaatatgaggtttgaatgtgttcaaaacggggaatataagccgggagatcttgccatacggccgtgattttgatgtgagcacatttctgtacatacttcgtttcgaaagttgtcctaattttccagccggccggctgggtatgtttgaatgataatgggaattatgtaaagagaacaatgtcttttttaaggaggcagcgaatgtctaagcaaggaaacttccagaaaactatgtcactttttgatcttattttaatcggcatgggagccatattcggttcggcatggctgtttgccgtcagtaacgtcgcctctaaagcgggcccgtcaggcgttttttcctggctgatcggcgggggaatcatcttattgatcggcttggtttatgcggaactgggcgccgcgctgccgcggaccgggggaattatccggtatcccgtatattcacacggacacctggtcggatatttaatttcctttgtcaccattgtggcatacacgagtcttatttctatagaagtaacggcggtccgccaatacgtggcgtattggtttcccggtttgaccgtaaaaggctctgattctccgacaattgccggatggatattgcaatttgcgctgctctgcctgttcttcctcctcaattactggagtgtcaaaacctttgcgaaagcaaacttcattatttcgatttttaaatatgtcgtaccgattacggtaattgttgtactgatttttcattttcacccgggcaatatgaccgttcacggattcgcgccttttggtttcaccggaattcaggccgcgatttccacaggcggcgtcatgtttgcataccttgggctgcatccgattgtggctgtcgcgagtgaagtgcagaatccgaagcggaacattccgattgcattgattgtttgtattatcgtttctactattatttataccgtgctgcagctcacttttatcggggcgatcccgggggataccctgaagcacggatggccggctatcgggactgaattctcccttccgttcaaagatatcgccgtcttgctcggtttggggtggctggcgacattggtcattttagatgcgattttatcaccgggcggtaacggaaatatctttatgaatacgacttcacgtctcgtctatgcctgggccagaaacggaacattattcagcattttttctaaagtcaataaagaaaccgggacaccgcgtgcctccctttggctttcgttcggtctggctgttttttggacgcttccgttcccttcttggaacgctcttgttaacgtatgctccgtcgcattgattctgtcttatgcgattgcgccgatttcttctgcggcgctgagagtcaacgcaaagaacattaacagaccgttttatttaaaagggatgagcatcatcgggccgctgtcgtttatttttacctcttatattgtatattggtccggatggcgcaccgtatcctggcttctcggttctcaaattgtcatgtttctgatctatctctgtttcagtaaatatgctcccaaagatgatgtcagcatacgccagcagctgaaatcagcatggtggatcgtcggcttttatgtcatgatgctgattttctcctatctcggctcgttcggccacggattgggcattatcagcaatccgcttgacctgattctgatcgccatcggttcgctcggtatttattactgggcaaaatatacaggtctgccgaaggctatgatcgacagtgataaatgacgaatgccggaaagaagtatggtcttctttccggtatttttatgttaagggatgacaaaaaagcgaacatgcgataaaatgaatgacagtcattcataaaaggaggaacccctctattggcaaaacaaagctcgggaaaatacgaaaagatcctgcaagccgcgattgaagtcatttctgaaaaaggattagacaaagcatccatttcagaaatcgtcaaaaaagccggaacggcccaaggtacgttttacttatatttttcttctaaaaacgcactgatatccgcgattgcagaaaacctgctcgacactacgctggacagaataaaagggaaaacggacggttctgaagatttttggacgttgctggacattttggtagatgagacatttcacatcacccggcttcataaagatattatcgttctctgttattccggtcttgccatcgatcattcaatggagaaatgggaagccatttatcagccttattattcctggctggaaggcatgatcaatacggccattgaacagggtgaggtcatcagcggcattcatgtcagatggacggccagaacgattatcaacgttgtcgagaacgcggctgaacggttttatatcggctgtgaacaggatgtcgatctcgaagtatataaaaaagaaatattcagctttctcaaaagaagcttgcagaaatgattggcggagaccgatcatttttgaccgccgtaaaaatgactgacattcattcataactgaggtgactgtatcatgtattggctgcttgtattgatagccggattgttagaagtagtttgggcgtccgccctgaagcatgcggattcgctctttgattggattggtattttccttttgattgccgtcagctttctgatgctgatccgctcttataaaaaaattccgatggctgccgcatataccgtttttgtcggaataggcaccgtcggcacatatgtaacgggcgtcattttaggcgaatcgttttcaatcggacaaatattctttttggctttgctgttgtccggcattttaggaatgaaggtatttacgaaagaaactgaaacaaggggtgaacattaatggcatggctgctgttatttattgccggagcggaggaagttgtagcggccgttgccatgaaacatattgacggttttaaaaaaaagtggccgctgattgtcatggtaacaggctttatgctttcattcttttgcctttccggagcgatgcaggttcttcccacaggtgtcgcgtatgcggcttggaccggcatgggaagcatcggcgtttcggccgtaggcatactttggtttaaagaaaaattcaatctgtcacaattggtgtctctggggcttatcctcatcggtgtcatcggcttaaaactgacagcgtaacggcctgagacagctttttaaataaaaaacaaaggaccctaaacgggtcctttgtttttttatgctgttttgatctgttccgcttttcccgctccgactccgaaaatgaaaatcagaacagagactgcgatcagcatgaataacggaaccgtccagccgtgcgtgatgtcatgcagcaaaccgaatacaagcggcccgaacgcggcaagcaggtatccgaatgactgggccatgccggaaagcgccgcggcttcatgaacatgccgggtccgcaggctgaagaacatcatcgccagactgaacgcacagcctcccgcaattccgatcaaaatgacccatagcggagtgagagccgggcttccgaaaagaacgccggcaatgccgataaggaaaaataaagccgtcagtccggcgagtgcgcgctgatttttcattttagcggcagcgatcggcacgataaaagtaatcggcaggactgagaattgcattaatgaaagcatccatcccgccttacttgagctgagtccattctgctgaagaatttccggcagccaagcgatgacggtgtaaaaaataagggattgcagccccatgaacatcgttaccttccaagccagcggagaccgcatcagactgttttttttctctccgtttgtcccagtcgtgcggacgggcagttcgcgtcctcgcatttgcggaatccacatgacgaacgcaataaaagaaaggatagcccagcagccgagcgcgcctttccagcctacccccgctgaagaggcgatcggcacgctgatgccggatgcaatcgcgccgcacagattcatagaaaccgagtagacgccggtcatgatgcctaaatttccgggaaacttatgtttaatgagactcggcagcaggacgttgcatacggcgatcgacaatcccaacaggatcgttccgaaaaagagagtgccgattccggcgatggagcgcagcagagttccggctgtcaggacaattaatgatgacagtaagacaatctcggtcccgaagcgccgggacaataaaggaacaaacggcgacagacatgcaaaggccaaaagcggcactgtcgtaatggtgccggcagccgcattggtcatgccgaggctgtcccgaattgaggaaacgagcggtccgaccgatgtcagaggcgctctgaggttggcccctatcaatatgactccgatgaccagcaatatcagttttttacgctgacttgcttgcagaacttgatgttcgtctttaattttcatgttcatcctccatgtgtattgtatctttaaatactgtgatgtattggttgacggcctccatggcctgatccggtttctgtccgataatcgcggcggcaagctgggtgtggatccggatagcaggggtgatttccaacaggttatggactgacgcacaaagcgcctccgtcatatgctcgtatagatcagaaagcatattgttatgggccgcctgtacaattgttttgtgcagcttaatgtcggcttcggcataccgttttcgatcttcattttgcaaggccgcttcacattcatccaagcatgccttcagtgctttcaggtcttcgtcattacgcctttccgccgccaatcgtgcagcttctctttcgagtgcgtatctgacttctaatgtttcaagcaaatttgattttttaatatggcggtaaaatgccgcgccgagaacactggatgagctgacatacgtaccgctcccctgccttgtctgcagcaggccggcatgtacgagcgcccgaatggcctcacgcaacgtgtttcggctcacatcaaattgcttcattaaatccagctcagggggaatgcgcgtcccgaccggccatttatccgattgaattaacgattcaatttgcgccaccacttgttctacgagcgacagtctgcttgttttggatatctccatcaaaacacctctgaaatttgtaggatgattctatcattgggtaatataacataaaagaagcgacgatgtaaatcagcggcaacaaaaaaagagtgagtttttctctcactcttcggcgcttttatgaacgttttatattgactgaggtcacgacaaacttgtcatgacggtggcgggaaaatgaatattcaaagggagtgccgttgtccaaaaagcctacatgctcgacttcaagtatcgggtcatccggccggcagccgagatattgctgatccatatcatccgacttgcacgctctgatttttctgtgtgtgcccgcgattttgagctgcaatccccgcgtaatatgatcgtagatggaatggttgagcacctcgtcattaatgccgggtataaggctcgccggcatgtacgttttttcaagaacgtacggttcgccttcaacgattctgagcctcactacataatagacgggagtcttttcatcgatagccaaatgtgcggcgacatcttgagacggaaactgcacttcaaaccggatgaccttgctcttgatatttttgccttttaacaaattgctcaagccgagaatttcgttgctgactacgtgaacgtgctcatcctgcatggctgattgaatgataaatgtgccgtgccctctttttctgaaaagcatcccttcagccgcaagtgtatcaagcgcccgcttcatcgtcatccggctgcacccgaactccgcagcgagcgtcttttcatccgggatcggctgatctatgtcatatacactgcttttaatcctctttctcatttcgttggcgattttttcgtacttattcatcggtttcctccggctgtgtaatgtttgatctgtatagactccttacggttatcataaatttttttccctgcttcatcaatgacgttacagccgccgatattgaaattgaaaggatttcctcgaattttctatggaatctccctcactattatggtagaattttttgcagaaacggacacaaccgaatattgcaatatattgtataacctcaatgatatggtttgagggtgtctaccaggaaccgtaaaatcctgattacaaaaattgtcccgtacactttttgtaatcaggattttttattttctaaaaaataaaaaaaggagtatctgtacatgaatttcaaagtatttctgcttgcagcatctaccatcgcagtcggattggttgaattaattgtgggcggtattcttccgcaaatcgcttccgacttagatatatccattgtcagcgcggggcagctgatcagcgtgtttgcgctcggttacgcggtatccggcccgctgcttttggcagtgacggcaaaggctgaacgaaagcggctttatttaatcgcactgtttattttcttcctaagtaatctggtcgcttatttcagtcccaatttcgccgttcttatggtgtcacgggtgctcgcttccatgagcacagggctgattgtcgtcctttctttaacgattgctcctaaaatcgtggcgcctgaatacagagcgcgggcgatcggcatcattttcatggggttcagctccgcaatcgctttaggcgtgcctgtcggcattatcatcagcaatgccttcggatggcgtgttctgttcttgggaatcggcgtattatctctcatttccatgctgattatcagcgtctttttcgaaaaaatacctgctgaaaaaatgattccgtttcgtgagcagatcaagacgatcgggaccgccaaaattgccagcgcacaccttgtcaccttgtttacattggcggggcattacacactctatgcctactttgcgccttttttggaaagaacgcttcatttgagttccgtttgggtcagtgtatgctactttttgttcggtctgtcagcggtatgcggcggcccgttcggaggctggctgtatgaccgtttaggagcatttaaaagcatcatgcttgtgaccgtttctttcgctctgatcctgtttattcttccgctgacaacggtttctttaatcattttcctgcctgcgatggtgatctggggattgctcagctggagccttgcgccggcgcagcaaagctatttaatcaaaattgcgcctgagtcttccgatattcagcaaagcttcaacacgtccgctttgcagatcggcatcgcgctcgggtcagccatcggcggcggcgtgatcggacaaaccggttctgtcacagcaacagcctggtgcggcggtttgattgtcattatcgctgtcgcgttagctgtattctctttaacgagacctgccttgaaaagaaaatccgcataaatgtgagaccgcaaaaaagccaaaggagttccttcggctttggcggtctttttattttgcggcagcaagctcgtcttctgtcacccatttatgattggttactttttggccgccgtcagtcggtgtatagtcgaccatataaacggttgtctttttggctgaatcaataacggcttcggcacccttcatgcctttcatatgggatgcctcgatcacggccttgtcacccggttttaacgttttatcaccggcgcccttcagctcttcctgaatgacccatttgtgatcttcgacgcgctttcctcccgtttccggagtgtaagatacactgtaaaccgttgtatcataagcaccttttacggttccttgcgcatttttcatgcctttcatatgagaagctaaaatcatgacgtcactgccgactttataagtcggattttcggctttctttaaacctttcggcacctcggatgaacctgagtgattcatgtcttcgtgagagtgcgtttctttgtctttcgctttttcgcttcctcctgaagattgaccgttgcatccggcaagcgccagaacggggatcaggagaaacatgctgaataaaaatagtctcgctttcatttcaagaactcctttgcctttttgatttttcattttccctttcgtttcttcggtaaaacaaaaagatggcctgtcatttctcctaattcttcaactctctctttattgccttttatcaggtgaaattgttcacaaaatgtacacattaatagagatgcagtataatttaattatcagataatagggggaactcatcatgaaaacgaaggtttttgcggtggtattgggcgctgttttaatgattgcggggttggttttggcagaagtttcgctttatatggaatacatcacaatggtcggagctatgattttttcttctatatttatgtcagagccgaaaagaaaatttcgcgtcattaaaggggtttgacttttctattaccgccgtcttctcaggacggcggttttgttttgcatgtcagtcagtctatccgcaaagccgtttcttctgtgccgtcctgatataaaacgaaatgcggggcagtttgtgctttatcacctgcaaattcaatttcaagcggcagcgccctgacaaaataacgggtttccgtcattgggaataattcaaatggtgtctgcccgtctattgcaagatacaatcggttttcttttaccgtcaccgatgcatgtgtgtcatcctgaaatgagtaattgccggtaaatctgctgtaaatcgcaggatcgatatctgcttttttctgatccgccggacgtttcggaatcacgtacggctgatcaaataagatgtttacggccgcggcaatcacagcttgttcaaattgatacgattgttccatattgctgagataaatcagtgttttgttctggtcaatataccggatcatcagagttgaataacccggccagcctccgtcgtgactgataaccttccctttttgggcgctgttttgaatcatccagccaaatccgtatccgaattgctcttcttcattccaatagcccggtgtaaacgcttgatctttagactctttgccgatgatttcttccttataaagagcctgatcaaacagatataaatctctaatagtggagttaacggttccgtcaccttgaatcccgtcaagaaagacgacataatcggtttcctcaagttcatccggcagcacatattctccggaatgaacatcatacacatagccatatgcatagtttggaatgttttctttactcagccttctgttataaatccgcgtatcgtgcatacgaagcggatgaaatacggcttgtttcataaattcagcaaaactcatgcctgatacaatttctataataaccgctaacaccgcataccccgtattactgtatagccactccttgcccggcgggaaataagcatccggtttatgctgcttaagcatatcgatcacatcttgattaacggcaattctgtcccggtcccaatgtgttaaaaataactccatatagtccggcaatcctgacgtatgatggagtaaatgccgaatggtaatgcccggataaggaaaatcaggaagccaccgctctatcatatcgtcataacgcagcttccctcgctgctctaaaatgataacgcctaaagctgtaaacggcttcgatactgaggccaattcaaagactgattggtcattcagcatcctctttgttttcagttctgcagcgccgaatgaaccctgatataagatgcggccgttttccgctgccaatacagctccgtttatttcatgtctttcgtctaaagtgctgaaaagctgttcaaaagcttgttttttcttatcgttcatttcacgaacctccatatacaagctgatttactcttttatacgaacagccgctttagaagtttcaatattttcccttcccggaacaccagtcagtaaactgccgttcaggcagccgcggaggtttaatgaaggtcttttattcgcacaacactgtgcaggcttcgaactcaacatgcttctcgtctttttttgcgccggcaatttccatagtcgaaaacatcgcacagatgacggctttgtattcgttcatgacggtttgaatttcaatcagaaaccgttcggatgaagaggcgtattccgttacgtattctttcattttgccgataatatcatctgcctgacggatgaagccggccgcctccaagtcactctcaaactggtttttgttgatcatatgaatatgcatttttcaaggcccctttcagcagcgttttatggttatatccactgtaaaggacaggcttggataaacttttaataaaatatgaacaaaatatgaattggctcatcggcctgaccggcgggctttcggctgtgctccgtttcatttggactacctgaaataatgacttctttactctatgaaaaacagctcatatatgatctaataccagtaaaatgaacgttaggaggcggcctatgtcagcagcaggaaatcggcaaaaattttgggtcatggcgatgcttatagcggtctttgccgtgtttgttttctctttttccgagaatcattcacaaaagaactggcacacggcggttgaccaggcgtcagtgaatgtcttcggccagcagatctttgaaaaagaccgtctggcaaaaacactcaacgcacgtgaggcagaatctcttctgactcttgtgaaacttgcaaatgaagaacatcacatcatctaaaagccattataaaaagcctgtttccctttggcagaggaaacaggctttttccatgtattattgagcatgtttttgttcaataaaccggtcgatccgggccagaacatcctgcatgtccatacattctttaaagctttcattaatggcttgaatgccttgtttgtattttccgttatgcagcacttcttccgcggcaagctttaccttttcagcgctcacttcatctttttgcactgtacagcctgcatccaattcagtcaggcggcgcgcaaccatcggctggtctttatcatgcggaataacgaccagcggcacttgataatgaatgccttcatttacactgttcattccgccatgcgtgacaaacacgtcggcctgctccagcacttcaagctgcggcacgtacggggcgatgataaagttttccggcgcctgtttgattttcgacagatcggctttttccccggcggcaatgactacttttccttcaaaatctgagaacgcgtctatgcacagattgaaaaacgcttccgtgtccccgagcaccgttcccattgagatataaatgactttttcattctttaatgagtcaatcgggaagtcgacgcgcccttttctcttcggaaaactcggaccgataaataaatactcatctccgaatgtctcactttcgggctgaaaatatctgcttgtatagacgacgttcaattcacctgtgttgttcataaattgaaccatgctgtcaggggcgacaccgtatttgtctttcatctcggccaacagctcttcacattccctgtccggctgaaacggcacgcccgattccggatggagcggcagtattttcagacggtcttcattgaacaggaaggatgctgaagaagagatgccgggaatgttgagataatcccgcaccaactctcccgcaccaaatttatcataatagacggcgtcgaattgaatgtcctctgccagccgctgcacaatatgtaaaatctccagtgacgttttgatatgaacctttaaaaatgcaagtatgccggacggactgccgggatcaatgggtgtcattctgagcagatcgctgtgaagatgaactttcgctcctactccttccagtctgcttttgtatttttccgttgagatataatgaacgtgatcgccccgttcgctgaaggcctttgtcatacccaaagtcgggtttacgtgtccttctgcgggaaaattgatcatcagaatatgtttcgccatttttcaaactcctttgccttttttgcgtctcttccatatccatcataaatgacgcggaaaaaatcatgcaaggaacattcgtcaggtctttatgacggttcgatgacatcggcaaaaaaagacaaggcttttcaccttgtctatcgtgatgattcgtctgtttcacccgctttgagcacacctttcagatgttcttcatcatgcttgagatgctccgtcatatattgcacggcttttgttttatcgcccttttttatttcttcaaagactttccggtgctcatgcaggataacctccgcacggtcatctcctttaaaattaagaactctgcaaaaatgaatcagcacattgacatgctcaagcagcatggccagccggctgttgcggctgaaatccacaaggagccgatgaaacgactcgtttaaggaaataatctcagtctctttgacgcctttattgatggcttcttccgtctcccgcagctgtttttcaatgaggtcaatttcactctcagccgcttcatcaataaccagttcgaccgccaatgattcaagtgacattctgatttgataaatctcttcaacatccttaacggacaaagaataaatgacaaagccgtttcgatcgtctgccgtcagaagcccgtccttttcaaggagccgcatggcttctctgaccggcgaccggctgactccgaaatccttcgccagctgagtctcattcagccgttcacccggtttaaaaatcccgtcaaatatcatttttttcaattgggaataaaactgcagataatacgggattggcttatctaatttaaaattatccatctttcctacctcttcatacaatttaggccttattgttaccaagatcatataacagtttatctatggaagcaacattccagagcttgtcagcataacggaggtgccgtaatatggaagtatagttggtcgagggtattccgtaaaccgaaaacaattcattcggaggtgacggaaacatgaagacatactagattgccggcataccgggggacggtgtggggaaagaagtcgttccgcaagcggagcgggtgttgaacgcgatcgccgaattacatggaggcattgcctttgatttcacttcttttccgcggagctgcgagtattatttggagcacgggactatgatgccggatgatggattagaaacgttacagcactttgatgctttgtttttgggagcggtggggaatcaaaaactcgtccccgatcatgtttcgctgtgggggctgcccatcaagatacgccggtaactacatctccgattttgatctgtaaacgtccgggaaggtgagtacagctctgtcggcagcagcatctatcagggtgaagatgaaatcgccattcaatacgcggtcctttcccggcggggtacggaatgagtgatctgttttcgaaccggcagcgttcggctggggttttgacaaagaaatgatacaattttttacagagatagagagagaaaattgtatgtcaaatcgcagcaggggaactgcaaggaaacggtaacccctcctttaattgtggtgaaaaaagaggatacacctacaagacaggtcgattaagatggtctattggcatcttacatccgcaaatatgtctttacacaaaaaagttagagaggtaaaaaatatgaaaaaaatattttacttttttttgatattatatataattatagtattattacttaattctgtatttgacttaagtaatgtattattaactgttttgtttgctatattcgttggtgcattagtgatttatagcattgcgaaacggagtaaaggtgatgagagaaaaaagtgttaaagaaggttactaaattatttatagcggggtgtattctcgctactgtgttgtctgctttcgctccaagttctgaagcagcttgtcgacggacaaatcttgggactcagtgtgataatgatgttcttcttaaaaaaagggtaaaggtttattacacaaaaaatcaggtgaaaaaagtggtttctagatataacagcatggggtctaataaagggcttattctcggttatattattgggttggtacacccttctactggtttaagtgttttaatgtatcaagtaggagctaataatatgattaagccttttaaaactgctaattctaagaaaaagggtttagagatttcttacacggttaccgtttataagtggtcaaatgcatctactaaggtatctggagtaaaatataaatatagataagactaagtaatacataatgagcaggcgatggcctgcttttttttattacaggagaaatgtgcaaaatgaaaaaggaaaactgaagtggaaatcgatctgcatgtcagggagcctgtgtgatgatgcgttcccagagtgagtcaacagtatgcggattgcagggaggattaaggagttgactcactcagtcagcattcaaacaaacttgtttcaatcggcggaaacacgtcacaagcgcgacgaaatcaaacggtattgttcactcgatgccgttctgggatgacatctttaaagaggtcagccgggagtacgccgggatcgagacggattcccagcacatcgatgcactggcggccttctttgtcacgcagcccgaacgctttgatgtcattgtcgcttcgaatctgttcggagatgtgctgacagatatcggcgcggcgattatgggaagcgtcggaatcgctcccgcagccaacatcaatgtaaacggcaaatatccttccatgtttgagcctgttcacggctccgccccggatattgtcggaaaaggaatagccaatcctatcggccaaatatggacggcgaaattaatgctcgattcattcggagaagaggaactgggccatctcctcttacaatctattgaaacggtcacaaacagcggtattctgactcctgatgccggcggaaaacattcaacggaagatgtcacttccgctattatttctcaaatcaagaacagataatacgaaaaaaccgcgggcaggaaaactgcacagcggttttttcgtctcagacgggacggagcgcgcagaaacaggccgattcacctgtgaagcccgcaatacggcctgattgatccttttctacagaaaaaaaccgctgtatatcacaaggagcatccagcatctgtttttccagtaatgcggctttctcttcagtcaggcttgcccgttcacaccagacggtaaattgaaatggtttcaaaaagcagacagcggattcaatccggaagccggctgtctccagaaaacgaagccattctgtttttttccacgcccgaaagtggctctgatcccgtttcttttcaatgtcattataaaaatggtcatattcatccttttcaggtgcggtattgtcaatgagaagcagtctgccgcccggtttgacaacccgaaacgcttcatgaacaaaggctctgacatcgggaaaatgatgcgccgcgattctgcatgtgacgatatcgaaagcagcatcggaaaacggcatcttttcagcatcgcctttttcgaatgacacgttcgtccatccgtttccggttataaatgcttcagcggctgctaacatttcttccgtgaggtcatatgcgataacagagcgtacgagaggagcgagagcgttagccgtatgtccgcctcccgtcgcgatatccagcacgtccatatgcttttcggcaccggaagctgaaatgagatatgccaaatcctctcctgcggcgtatccgggactagtcacatatttcgcggcgtttttagcaaattgccgctgcgcctgctgtttaattgaatcctccattatacttgggcccccttttctttctgcttgctgccttaatcaaaataaacgggttcgtccggatgtttgagatatgcaaacatcttttcaatctgactttccgtattgcgggcttcagatagcggcggcagttccgtttccgcaaaaaagccggccgcgcttgtttccgttccctccctgagccggccgccgatgatctcgcatcggataaacactttgtaaacgtgggcggcggacggcgggtgggaatggcatttcttatccattacagctaacagtttaacgggctttacgtcgattcccgactcctcttttacttctttgacagcggtctcgcccggtgaaatcccgatatcagcccatccgcccggcagcgcccatctgccgtcgcttttctctcttaccattaatatgctctgatctttaaaaactgccgctctgatatcaactttcggagtgggatagcccgtgtcaccggcgaatacgtctttgatgatgcttttgtcgatgccggtatgttgcgccatgatatccacgcttatttttcttatttcttcaaatctctcaatatcatatatgtctttggaataagccagccccgcttgcgccgcggattgaagctgttttgcccattcaagccattttggctccattttttccaccgcccgttatgttaattaaacgaaacccgaattgcaccttgagagtaccccgtttctgctccttgttttctgtttatggcggagcgaatcctgccgggaaatcagaaaaagccattcatttgctgaatggctttttttcattttctatttttctttcatgacgagaacgacgcctgaaacaataagggccgccccgatccagaaggttcctccgatcgtctctcccagcagcagccagccgagcaatgtcccggaaagcggctgaaagaagaaaaacagaccgccgcttgccgcattcagcaattgtaatccgcgattccaaagcatgaacgcgcaggcggttgagatcacacccagatataaaagtccgccccatatctcaggccgggcaagctgagacaaaggaatctcccgaagcgggccctctgtaaacggggtcaggatgacaaatgcgacgcaaatggaatacgttgtgacgacaagcggtgagtaatggccgggaacccgtttcatcagcacggacatcaaagcccatgtcagcgccccagccagaagcgagagaccgccgaactggctcgacatattgagatctccgttccccacaatgagcaatactccgatcgtcgccagccctgtcgatattccttttttcagcgttaaccgttctttcaaaatcagccgggcaaatacaaccataaatgcgggagtggatgccgtaataatcgcacccatctgcgcggttgataatttcgtgccgatttcctgcgtgacgatcgaaatcgtgttgccgatcaatccgatcgcagcgatcagtaataaatcacgtttatgaactttccaggattggcgtgtaaataaactgagaatcaaaagcgaaaaaagcgccaccgcatatctcagccataccagttcaagcggcggaatgaccgctaccactactttaacgacgacatacataccgccccagatactggcggccaatgccaaataaatcgaaccgaacaatgtatttttcaatttgatgcaccctccgttatcatattaggtcacgtcatatgccttaacggagagaagcgcagtcactttcctccattaagggcggagaagtgctgccggtacatcatgttcaaataagggcgctagaaacatatcgtttttcacctcaattgcaatctgatttttctcattatacaaggtttgtcagaagacgtaaacgaacggcggcatcggctttatcgattgcggacttgcagctggattcttgtgatctgattgtcaaacccgtccgccacaacctcatcaagcaaatattcttcatatgcataatcgcccatttccagcccatactcttcaataaactgcatgatgctgcggtaagccgcttccgcttcatcccctatttggtacccgacggcataaagccctttcggcttgatatggaggtcattattctctatgccttcttctgtcttcatataaaaatgggtgtagttgtagaattcttttttcagaatctgctcccgcgcaaacagtccgccgaccggatgcccctgatcgagttcatgtacccgcatatagcggatcaattcggaaatggccgcagtgtattgccgttctggcaaatggagtacgggtcgtcctatcataagtgtctcttcatctaatcgctgcaatgagacggaggagaagtctgtctccaaagcttgttcggtcagcttcacctttgtctgaatcattctttgcaggtgctccagctttttgattttgctttcgatttctgatgatttctcttttaaaagcgtgatgataccctcaggggttttgtctgttaagagcggtttgatctgcttcaagggcacgccgacctccttaaacagaccgataacctggaacagttcgaattgatgataggaatagtatctgtatccgttcgcttttttgatttccggagaaagcaggccgatttcgtcataatggaacagggtttgtttttttacgtggcacagttttgcaaattcacccgttgtgaagtattttctgacgtcttcgctcataatgcctccttgactatacggtaaccatatcctttatgatgatcattgtatccgagagaaggctgattcacaaatggcttacgcaatgaaagctttaccgtctcagaaaaagcagaagaggagtatcaagtatgacgattgaaatcagagcagtcacggaagaaaaccgtgctgatatactggcgcttcatgtaagggaaagccagacttcatttattgaaaccgcggaagagtgcttacaagatgctgaggattgccggcattatcagccggccggtctttatgttaacggggaattagtcggctttgccatgtacggatggtttccggaatatgatgaggaaaatgaaaacggcagagtgtggcttgaccgtttttttattgatgaacgttatcagggacgtggattgggcaggctgttgcttgatgcccttatccgccatctcgttcgaatatatgagtgcagacggatttatttaagtctgtttgaagataacgtgcacgcattgcggctttatcaaaaattcggcttcttattcaatggagagctggactcaaacggggaaaaagtgatggtgaaagagctgtaaaccctctgtataaaagcgattcggcttcttgccaatccctcaaatttgaggtaacataaagataatggacgacggtcgacggacgacgatcgattgttaaaaacctgataaagcggatctgaacatggtgatcaggcatctaaatggaggagaagattgtgcttattatactcgttatgttccttctcgggattattctagggtttatcggcgcggggggagccggttttgtcattgcacttttaactatactgtttcacgtaccgattcatacggctttgggcacctccctcgccggaatggctttcacaagtttatcgggggctttcagccactaccgtgaaggcaatattcagatgaaaatcggcctcatcgtcggcgtttttgcggcattcggttcgtttttcggggcaaggcttacttcccttatccctgcagatttgctgcattacttgacggcgggcatgctgtttttatccgctctgcttattttagtccggttatttattgtaaaagaaacacatgaagattccggacggcaaagcaatctgaacatatgggtgaaagccgttgtactcggtatcatcgcaggaatcttgtccggaacgttcgggatcggctctgcccctttcatccagatcggcttaatgattcttttgcgcttatccatccgccagtcggtcggcaccaccatgcttgtcattatcccgcttgcggtcggcggaggactcggttatgtgacggaaggatttgtcgattatatactgttggtcaaagtgctgatcggcacgatgtgcggcgcatatgtcggagcgaaattcaccaaccacgtgccgaaagtcattctgaaatcagccatctttttaacaccggccatcgccggtctcatgcttttattttaaactgaaacgggaggcggccgcctcccgttttttctgttcttcacctgttttcgaagagctttttcagctttgcttccgtttcggtatgatctaccggcgtatacacactgcagcgcagatcactgttgccctgaacctgaaatgaagtcaggttaaagaccatttttcccgccttcgcgtggcggaactcaattaatacttcgggtgccgagctgacttcgctctcattccacagcgtatgaaattccgaatacgttttctccatttcttctataaactgagaataccacgtatcagctacatactggccgtagtacgttctgaaaatggcgatgaatcctttcacaaagtgctcccagttcacagctaaacttcttaattcttttctggaaaacaatagctctatgagattccgtttttcaggaggaatttgttcaaaatctaaaaacacgtgagccgcggcctgattccatcccacgatatgacagcgcctgtccgagataatggtgggacaataacggagctcctgcaggatttttgaaagcgacgggctgataaccgcttcttcctccgcggcaaacggctgcttcacgccctcctcaatggcaagcgcgtataaataatttctctcatctttgttgagctgcagcgcatcggaaaccgcgtccaatacggctgcggacactttaatgtctctgccctgctccagccacgtataccacgtggtgcttacgcctgctaattgcgcgacctcttctcttcggagcccgggcgttcttctccgtgtgcccatcggcagcccggccatctgcggagaaattttggcccgctgcgtttttaaaaactctgagagcgcctgcaatcttccttctggtatcataccgaatctctcctctcttaccctggtattcattatactaggataatcaacaacttgtaataggataattgcgagttacaataaatacataccgaaggaggaatgaccatgaaaagagttgtgatcaccggaatgggagtgatttcacctctcggcaatgatgtgcatacattttggaaacacctgacggaaggaacatcgggaatttctctcatcgattcgtttgatgtctccggctccaagacaaaaatagccggcaccgtccgtgattttgacgcagaagaaagatggggcagaaaagaagcgagacggcttgaccgtttcagccagtttgctttagcggcagcggaacaggcgcttgaaagctccgggattcagctcgatcagattgaccgtgaacgcctcggcgtgtacgtcggctcgggaatcggcggcatcacgactttgattgataacgttcatactttaaatgaacggggagcgcgaaaagtgagcccgagccttgtccccatgatgatctcaaacgcggccgccgctcaaatcagcatcagattaggcgcgctcggcccctcactttctcccgtcaccgcgtgttccatcggcaatacgtcgatcggggaagcattcaacgccattcggaatgatgacgcagatattatgtttgccgggggagcggaagcggcgattacgaatttgtcattagccagcttcggcaatgcccacgcgctgtcagcgagaaacgaagaccccgccgcggcaagccggccgtttgacgctgatcgcgatgggtttgtcatgagtgaaggcgcgggcatcttagtattggaatcattggatagcgcaatcggcagaaacgccccgatcctctgtgaggtgctcggctacggcgcaagctctgacgcgtatcatatggtggcctcccatccggaagggacgggcgcatacctggcgatgaaaaatgctttgaaaaaggcgaacgtttcagcggaagacattgatgtcgtaagcgcccacgcgacaagcacaaaagccggagatctttctgaaacattggcaatcaaaacattattcggggagcttgcgtatgacattccggttacggccaacaaatcaatgctcggccacatgcttggcgcggcaggcggcgttgaagccatcgctctgacagaaagcctgagacacggcatcatcccgccgacgatcaatctgcagcaccctgattcggcatgtgatttggactatgtgtcagacgggccccgccatcaatcgttaacgatcggcctttccaactcattcggctttggcggacataattcggcgatcgtgctgaagaaatatgaatagcgggcatcaaaaaaaggagtgaatcatttcactccttttttgctttctccggttttgttgttaaggcaaaaaaagcgatggaaccgataacggatgtcgtgaacataattgcccccatcggcacggccgtcgcttcattcatccccacaagcggcgacacgatggaaccgagaagaagcggaagcatgccgagcagtgcgcttgcgcttcccgcgcggtgtccctgcttttccatcgccaatgtaaaggtgcttgtcagcgtcatgccgatcgtaatcatataaataaaaatggaaatcaccagtgccgccagcggtccgtgaatgatcgtcatgacgagcagaacggcagtcgccgtcatcgctgtaatcacgccgattttcagcaggcttttttcgtgaatgatcccgccgaaacggccgatgataaagcttccggtaatgatcgccagaccgtttatgccgaataaaacactgaatacctgaggcgatactccgtaaatatcctgatacacgaaaggcgttccggagacatacgcaaagctcccgccgtgaataaaaccgaccgtcagcgcatagccgataaatgaccgatccttcagcaggcttcccattgtccgcacggaatttccgatggagctcggaatccgcttttccggcggcagggtttctgtcagcttgagcgcaatgatgagaacaagcaaaaacccgataaaggttaaaaacagaaaaatcgtatgccatgatgcaaacggaagcaataaaatcgcgcctcccgtcatcggcgccaccatcggcgcgacggcggtaatgaccatcagcagcgagaaaaatttagaaagttctcttcccgtaaacacatctctgacgattgcacgggataaaacgagtcccgccgaagcggtgaatccttgaagaaaacgggcaatcaccagtgttgaaatgttcggtgcaagcgcgcaaaacagagaaaacaaagcaaataaaaaaatacatagcaataacggttttcttcttcccttcgcgtcacttaacgggccgacaacaacctgtccgattgtcagtccgatcagacaagcggttaaactgagctggacaagcgaagcgcgggcgcttaaatcttcggcgatttcagggaaactcggcagatacatatctatattgagcggccccagtatcgcaagcattccgagaagaaaagccagcgcaagccgctccttaccggtcggattatgcagcatatcgttcccacctttcctttgtcaatctctcaaaacatttgtatattgtatcataattttttctttatttttaaaagttttcaaagggcataaaaaaaaccaagggctgtaacagcccttggttccgggtcacgcggtaaaaggttttacgcgtgtttttctttaaatgcttttgcgtattgatcagccgctataatggcgtccgccacgtcgtcagccgtcacgtcaaaagcggcatgaatcgtttcttcttcaatcgtcgcggcttctgccactttcataatgtcctctttagatgcgtctttcattttgatgtcttcaagtgtgacaggcagccccaagctgatataaaacgcgatataccgctcaatttcctcaagcgaacgtttttccagcgccaattgaacgagcgtgccgaatgccactttttcaccatgggtcaagtgatggatttcaccttcaagcgcggtaaatccgttatgaatggcatgtgccgcagctaagccgccgctttcaaatcccagtccgctcagaagtgtattggcttcaaccaccgcttccaatgcgggcgtaacggctttcgctttcacagactcataagcgagacggccgtatttgaataataccgcttcacatttttccgcgatagcctctccggcgattgtcggaattccgcctgccatcgttttaccgccattggcgatgacactgcgcgcctctatccacgtcgccatcgcatcggcaatccctgatgctaaaaagcgcggcggagcttccgcgacgattttcgtatcgaccagaaccaagtcaggattcttatgataaaaacgatagttttcgaacgcgccttgttcagaatacacgacagacagcccgcttgtcggagcatccgttgaagcggccgtcggcacgataacggtgtagccgtttatttcatctgatacggctttggccgtatcaagcgttttaccgccgccgactccgatgacaatagtcgcccctgctttttctgcgatgccggcaattcttttcatttcttcctgggaggcttcgccgttgaaaaccgcctcttcagaagagatattgcttttctttaattcagccgtcaccttgtggcccgcgatatcccatacggttttgtccgcgatgacgacggctttttcaccaacgccctccagatgtccgccgatcgtttcaatggcgttttttccctgcacgtatttggccggactgataaaaattcgttccaatgtcatcatcccttcttcgttgtctctcattacatttctcttattgatagagcggaaatgaaaactcttctgatataattcctcgttttaacttggtttaaacctcatatacactgcagaaaatcaattttcacggcattgacaagatgtgaaggtgtctatataatcttcgatattgaagctgatcattctttactgaatgaacaaacgagattgtgaatgattcgtcttaaaaattatttagttctgctggataatttttgaggcgtttttgttttatatatatttttgactgcggaggaggtttgcacatgaagaacatttgcaaggatatactgatgattatggccggagcctttcttatcgcggcgtccgtggaatttttcgtcatcccgaatcatttaggggacggcagcaccgtgggaatcgctctcgttttatattatcttttccatatacctgcaagtattacgactctggttgtaaatttgatttttatcgggctggcttataaatttttaacgaaaaaaacgattttatacacgatactcggtacgggaatgacttctgtttttctcagcatcgtcagctttattccgttcggcgtgcacgacatggtgctcgggattgtattcggcgctctgctgatgggagcggggctggcattgatctttatcgctgacggatctaccggcgggaccacgcttttggcgtatttattgaattacacaaagggctttaacatctccaaaagcatgttttatatggattgtgtcatcattttcgcatccgttttagcgatcggaatcaatcatatgctgtatacgtttatattcgtttatctgtgcgccaaaatcgtcgatattgtcattgagggtttccataataaaaaagccctcaccattatgtctgaccaatacgaagaaatcgccaaagccatcacctccgagtacggcaacgcggcgacgattttttacggatacgggtattacggcagcaaagacaagcgcattatctatgttgtcattaaaaagaacgaattgctgaaaatcaaaaaacatgttcaaaaaattgatccgaaatcatttatcgttattcatgaagtaaaagaagctgtcggagggcaattcgggtttacaaacctgcccgccgccgcaaatgaaaaataaccgcctgcagtgtatagctgcaggctttttttattcggctcttccccgctcaaaggttttttacatctttcaatcgaagtagtaaatgaaaccttttttgatggaggaacataaaaaaatgaatatcaaaactgaaaggctcgtcattcggacatttgaaccggaagattggcaggatgtctatgcgtacacctcgaatccgagtgtcatgaaatatataccagagggtgtctttaccgaagaagatgccaggaaattcgttactgaaaacagcggtgaacatgccgggaagtttcccgttttattgaaggatgagaaaacggtcattggccacattgttttttttcagtattttggcgatcatacgtatgaaatcggctgggtgtttcacccggaataccagggcaaaggatatgcttcagaggcggcgcgcgccgtgctggcattcgggtttaacaagatgaaattacaccggatcattgcgacatgtcagccggaaaacatggcttcgcaccgggtgatggaaaagatcgggatgaggcgggaaggcttgtttaaaaaatgcatcccccatgataatgaatggtgggatgaatattattatgccgttttagaagaagagtgggaagcctccgatctggaataaaaaggcttataccctttgcttttacagataagtgtgtgctacactgttcgtaacaaatacgaagggatgatgggtggacaatgattaactaatcttattttgaccgtttgaaatcaaatatttcaaatcagaaaaaataggattagtctgcccattttctatacgatacgagaaagctatgtaaaaatagcttatttgatcacgcacaggtacggctaatccttccaaatcaattgggaggattttttgtcctccctttaaagcgagggattgacatatgaaagaaatgttaaaaataagcggcatcagttacgaaatcaacagcgttcccctttttgaacagatcagcgcgagtgttcagcaaggcgacatcatcggtgttatcggtaaaaacggcgccggcaaatctttattgctgcaattgatctgcaataaaaaagcgccgtcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattaagcggcggagaaaaattgaaagcccgtcttgccaaaggtttctcctcctcaagcggccttttgttattagatgagccgacgaaccacctcgatcagcacagtttagaaatactgcttaatcagatcaagaattacaaaggcaccattattttcgtttcacatgatcgtgcttttatagatgcggcggcgacaaaaatctgggccatcgaaggaaagaaactcattgaacataaagggaattattcaagctatatggaggtccgcaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaatatcaccgcgtaaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagtgatgtcacaaagtcatatgaaggccgaacgctttttaaaaacgtgaatttcactgtgatgcacggtgaaaagatcgcgattacaggcccgaacggcagcgggaaaacaacattattgaaggtcatcctcggtcaggaaaaagcgcagggcggcatatggatttctccgtctgcaaacgtcggctatttaacccaggaagtattcgaccttccgcttgataaaacccccgaacagcttttttacaaagaaacgttcgaagcaaggggaaatgttcaatccctcatgaagcatttaggatttaccgcagcgcaatggacggaacccatcggcaagatgagcatgggagagcgggtcaaatgcaagctgatggcgtttattctgggggagaaagatgtgctgattctggatgagccgacaaaccaccttgatctgccgtcacgcgagcagcttgaagacactttggcccgatacgacggaacgctcatcatcgtatcgcatgatcgttactttgtcgaaaagacgacggacatccggcttgatatctcaaacggcagcgtccgaaaacaatggaaagaatctccctccgtcagggatgatgctgaagaactgcgattaaagtttgaaaccgaacggcaggaagtcctcggaaaactcagcttcatgactccggctgataaacaatatcgtgagcttgatcaaaagttcaaagagctgacggaagaaatcaagaagttgaaatgaatgtaaaaacccgtgattgtcacgggttttgttttggaaagttcacgtattatgaagaataatttcaaactgatttgtacaacctacgttcagattcatacgagaaggttcagaaagaaaggttcaggtgaacgcagaatggccaaacgcatcggaattacgggaaacattatggctgatcaatccggccctttcccgggttataatcgggcatatgtcaataatgattatattcagtctgtttctgaggccggcggtgtgccgtttatattgccggtgattcaagagacggcgcttttaaaggaacaggtctctcatgttgacggcatcattctgtccggcggccaggatatagacccgctgttttacggcgaagaacctttacaggctttaagaaagacctttcctgatcgggacgcctacgaaaaggagctgattctcacggcggttgctttagaaaagccgatactggccatctgccgggggatgcatatgttaaacgttacttacgggggaactttatatcaagacctggcacacgcttcgtttgctgacattaagcatgaccaagaaaaagatccgccgttaaaaacccatcatgtttcttttgaaaaagggacacgtctccataccttgtttggcgattcagcgcgggtgaattcattccatcaccagatcataaaagagacggcgccttcatttaaagccgcggcttatgcgaaagacggggccattgaagcgattgaacgaacgggtgaattatttgtcgtcggcgtgcaatggcatcccgaaatgctgacaaaaaaacatgaagacatgaaaaagcttttttctctgttcatgaatgcggtcagcacataaaaaaagcagatcataacgatctgctttttcattttattcttccggtttctccggtgttttgccttgtgtcagcttatggccttcgatatccacgttcggaatgattttatccagccacttcggcaagtaccaggccgcatgtcccatcagcttcatgacactcggaatgatggtcattcttacaatgaacgcatcgaaaagaacaccgaaggtcattgccaaccccatggatttgatcgtagagtcccccgcgaagatgaatcccgcaaagacgaaaatcatgatcagtcccgccgctgttacgacaggtccgctatgtttcaatccggcatggatggcttgtaccggattttttgttttgacatattcttctctcattctgctgacaaggaatacttgatagtccatcgccagcccgaaaagaataccgatggctaaaataggcaggaaggcgagaatcggacctttttccggaatgctgagcaagccggtgaaattcccatcctgcagaacgaataccgataacccgagtgtagcggtcatcgtcagcaaaaagccgacgacggcggcaagcggcacgagaagcgagcggaaaacaacggtcagcaatacaaacgcaaacccgacaataagaatggcgaatttcggaatcgcatcgtttaaccggtctgaaatatcaatattcaccgctgttgacccggtgacgagcaggcggatgccgtttttgtctgatcgtttccgtatatcctgcactaactctttcgttgccttatcattcggcccggtttcaggcactgccgtaatgatggcataatcccctttttgattcggcatggcaggtgtgacgctcgccacattgtgcaagtcctttatttctttcacggcgtcttgaaatgcttcacttttattccccttgactccttttgcatcggcaacaattgtcagcttgccgttaaagccttcgccgaatcctttagacaacagatcataggcgcggcggtccgggctgtctttcgctttcattcccgcatcaggcagccccagttctaaatgcatggccggcagactgatgacagctaaaagaataatgctgaaaatgcttaacagaataggcttctttgtaacgaagcgtccccaggcattcgtgtcggcgctttccttttctttcttcttgtttgatttcggaatcatccgttttcctgcgattgacaacaccgcaggaaccagcgttactgatgccaatacagccatcagcacactgagtgccgcagtcaatcccatcgcagacatgaacggaatgccgacaacggtcaatccgcaaagcgcgacgatcacggtcagtcccgcaaaaacgacggcgctgccagccgttcccgcagctttagcgatcgattcatttttttgtacaccttcgcccaaaaactgacgatgcttcgtaaagataaacagcgcataatcaatcccgacggccaggccgatcattcctgataatgagagactgaccgaggctatcgtaaagatctgtgtcccaattaacgtcagcgcgacgcttacacctaacccgatcagggccgtgacaatcggcagccccgctatgactaatgaaccaaacgtaatggccagaacgacgaaagccagcacaacgccgacaatttcagatacaccgccggcttcaacaccggcccccggcacatcgccgctgagctccgtctgcaggcccttgtctccggcggcggacagactgtgtttaatatgtgaaacagacgcatccgtaatgtcatccgccgcttttttgtacgtaatatcggcatatgccactgacccgtctttagaaatggttcctgtttcaaaaggatttgcaatcgaagcgaccgaatgatctgttttgatcttctttaatgtctcttcaatcgcttgtttttccggttttgacgtcaatttcttcctgtcttcagctccgaaaataacccgtatgcttcctttatcgggcccctttgaaaattctttttgaatcacatccatcgccttttcagaaggtgtgtcgggaattgacatatcctcagaaaaagcaggttttaacgagatggcgatcacaatcgaagcgatcagtatcacgagccacgcactgatcattttgaatcggttgcgggcagaccatccccctaatttatataaaaaaccagacatcgaatactcctctccaatcattactttctgcctaattgtagttcacattcacataaaaaaaacgtacataggggcatgtacgtttgggcagtttttcattatatattcagtttcagaatgcctttttgcatagcaatggtgacggcttccgtccgcgaatcagcgcctaatttgttataaatcgatgttaatctcgcttttaccgtccgctctgagattcctaaatcgaaggcgatcgctttgcttttatgtcctttcgcaacggcttgcagaactatgatttccttgtccgtcagctgtgtttcattggcatttgcccgttccattttcttttcccggaaacgccgcaagatgtccggctgcagaagcacttctcccctgaccgccgcatccatcgtatgaaataaggtttctgagcttgtgtccttcagcagataaccgttcgcgcctgattcgatgccttctatcatcagatgatcttcattataggtcgtcaaaataataatcggcacatcagaatgctcttttatctgtttaatggcttccagcccgctcatttccggcatgtacagatccatgagaatgacatcgggctttagttccgctgcgaggcggacggcggttttcccgttttccgcctctcccgttatggtgtaatggtcatttgtttctatcaaaagcttcagaccttctctgacgacaagatggtcatctgctattaacactttatacatgttccgcttctccttgaattggtatgatgatctcaatttgagttcccgctgatctggcgcttgttatacggaaagtgccgttcatcatattgacgcgttcttgtatccccagcagcccgtaatgtccgctttttctcatttctgttccggcatcaaagcctttcccgtcatctttgacggttatgcggatctgtccctcttcttcctgaacggacacccagacattctttgcttctgcatgcttggcggcgttagtcaggccttctccgatcatgtaatggcaattctccgccgtatgaacgtcaagcacatgatgcacgctgtaatctaaaaaacaagacagcccggaggcttctgtaaaatggttgatttgttcagtgatgctttcttttaagaacccgatctcttctgatttgctgcgaaggttgtcaatggccgagcgcgcatcagccaatgtgcccttcactctgtccattgactggctgatgatgtctttcgctctgtcagtgttaccctttgaaagatgaacatgcaccgcttcaagctgcatatgcaagctgaccagcccttgtgcaagtgtatcgtgcaagtctctcgccatccgctgcctttcgttttgaagcgtcagctgtttcacttgccggtgagcgagctctaatttttcaagcgtcatctgtgttttgattttttcatcaacttgcgcgaaaaatgttgccgcatatgtgataatcacgatcatgatgggagcggcgataacgatgaaacgaagcagatgatgcggatgctcctggtgcagggctgctatggacattaaaatgaaaagatagagtatgagcggcgttttgcccttatccgccattccgataatctgcccgattaaaaaggcatagagaccgatgaccgccgcgatatagccgccggtcatcaagttagccgatgtatatatgataaatccctgtatgatgaaataaagaaacgtttttttcttgacccagcgataggaatgccagtgcagcacagcaaaaatgacgatcaatatcgtgaataacagcagcaataaaaccgtccagctttcataaatgtactgcaaagagactgatgcggcatataccataaaaataaacgccagaccgggcacccgaagcgcaagcatatgcaatgagcgtctgtcacgggagacatagtcttcttgatgttttgtaccaaacaatctctgtccacttccttttagccgaccggcctcacgatgttttattctatttgtcatcataccataatcgcctgcttctcaccttccccttctgtcctgcttgacgggtgaaagaaaaaacagcctgcgggattgttcgcgggctgcttttgttcatatcttttttatgacctttcccgggtttcagcggtctgtctcccgcgcggcaaaaccgcccgcgcatcagaaaaacgttcaggacaccgacagccattccatgtgaacaagaggaagcgattgtgcttcctcttttttaatgtaccgtcaaatttcttctctctttttttataaacaaaatttgtaagactagagctcttttctcaggggaaattaattatgtaattgagaagaggaggtttaaaaaacgattatggaaaagcgtgaattagcggctcacgagtcgctggacttacatgaaatcattaacttcaagacgctttgtgtagcgaaatccaagctcatgcaagggcttgtgtttgatcaggatctgaaaacgttaatggaaaaagacgttcagcaagcctcgcaaaaccttgctgatctgcaggcggtttatgaacgggcaacgtttcaggctcctgttcctcaaaaccggccgacttcgatcatcaattgaaaggaaggtaagcatcattgaaccatgaccatttagatccaatcaattcattacacgtccctgaactcgcagatatgacattcgcaatggattttctcatacgcgcaaaagaaggcgtcagaaataccgccgttgctttaacagaaaccgcctcgccagatgtaagagctttgctgcgcaaacagctcatgcaaggaatcgcgatgcatcaggaaattacagacttgatggtcagcaaaaagtggtttcacccgcatgatctgagcgaacagtataaactggaccagctctctgcgaaaaataccctcatggtcggaaacatgaatctgtttcccgttgaaacgaacagaaaagggatgtttgaccgcacacctgatgaacactaacactggaggtattacagcatgaaggccgtaacgtatcaaggagtgaaaaacgtcgtcgtcaaagacgtgcctgatccgaagattgaaaaacacgatgacatgattataaaagtcacaagtacggcaatttgcggatcagatttacatttaatccacggactcattccgaacttgcaggaagactatattatcgggcatgaaccgatgggcattgtggaagaaaccggtcccggcgtgacgaaagtcaaaaaaggcgaccgcgtcattattccttttaatatcgcctgcggagaatgcacttattgtaaaaatcacctggaaagccaatgtgatcaatcaaatgaaaacggcgatatgggcgcttatttcggctattcagggagtaccggcggctatccgggcggccaggccgaatatttgcgcgtcccttttgcgaactttacccattttaaagtccccgaaacatgcgaagaaccggatgagaaattgagtgttattgccgatgcgatgacaaccggtttttggagcgttgacaatgccggcgtaaaagcaggcgatacggtcatcgttctcggctgcgggcccgtgggccttttcgctcaaaaattctgctggttaaagggtgcgaaacgcgtcatagccgtagactatgtcaactaccgtctccagcatgcgaaacggacgaataaagtggaaatcgtgaacttcgaagaccacgaaaatacgggcagctacctgaaggaaatcaccaaaggcggcgccgacgttgtcattgacgccgtcggcatggacggaaaaatgacagatcttgagttcctcgccagcggattaaaacttcaaggcggggccatgagcgcattggtcatcgcgtcccaagcggtgcgaaaaggcggaacgatccagattacgggtgtgtacggcggcagatacaacggatttccccttggcgatatcatgcagcggaacgtcaatatccgatcaggacaagctccggttatccattatatgccgtatatgtttgaactggtgtcaaccggcaaaattgatccgggtgatgttgtaagccatgtcattccgctcagtgaagcgaagcacggctatgagatgtttgacacgaaaacagatgattgtattaaagttgtactcaaaccttagagaacggaggctacagaaatggccagcgccttacatgaattactcgaaattcaggagatggcttcttttaagtcactttgcctgacgaaatccaaaaccatgaaagcgctcgtatccgatccgcagctgaaagaaatcatgcagcaggatgcggatacatcaacaaggcaattgcaggaatttgcctcgattttatctgatgcaaagcacgaataggagatgaatgacgaatgaatccgattattgaatacctgacggggatggatgcactgacagaccaaattgtcgctatggatttattgaattcggcaaaaagcggagtcagaaactatgcgatggcggcgacggaagccggaacgcctgaagtgaaagcgatcctcacccgtcacttagaagaagccatcgacatgcatgagcaaatctcacgctatatgatggaaaaaggctggtatcatccgtggaacacagatgaacaagtccggtttaatttgcaaaatattgatacggcgctccgcctgcccgtcctataaatgttttcctgctgagacagcacctctggctcagcttcagtatgtcaaactgagaactgcctttacagcgcccaggcaacgaaactcccgcgaatcagctctgcagcttctccagcctttcttcgggctgttattggggcttgcggcggtgattacgtgcgtggcggccgccgggcggttcgcaaatagagcgaagaaggcagaacaatttgttctgccttttcattattttctgccccataggcacaaatacttttcacccgattcgagcggcggttattcacgtagcttgaactcccttaaacgcactcatcacaagatcatgcacataggaatcattcacctcatcacctgtgatcaacaggcgatagaaaatcggtccgtaaatgagatcgatgcttacgtcaatatcaagattctctcttaattcacctttctgaattcccttttccagaaggcctttcgcttggaggcggcggggctggaaaaatcgcgtgcgatattcttccgccaattttgcatccagctgtcccgcaccgattaattccttaataacggttccttcccggctcgtcaaaaaccttgctaaattcgcggcgtgggtcaatatatcttgcactgttgatcctgtatcgggcacaggcagtctgtccgtagcggtcgaaagaaagctgtccatgataacggcagccttgtttgaccaccatttataaatcgttgccttactcactttggcacgctctgcaattttatcgactgtcaccgcgtcaaagccattttccaacaataggtcataggcagcagaaagaatcgccttatgtgttccttcatcacgcggccgtcctcgtttactctgcacatgaatcattccttcccgaattataaacgatacgttcagtatacttaacctgtataaaaaaagaaaacagaaacccatttacaaaactgaacgtttagtatattattcacttataaacaaaactgaacgtttagtttataaaataacttgagggaagtcttgatgaaatgcagactccaaaagcctctgcgtaaaggagatgaatcagcaaaatatttatcaaacctcataaaatcattaaaaaggagttcattcatatggctaaagaaaataaacaaacagcggatcaggggatttcaactggtttaacccttcttctcgcaacggcatgcggtatcattgtcgctaatctttattatgcacagcccttggcaggattcattagtgcggcaatcgggctttctccaagcagtgccggattgattgtcacgctgactcaaatcggatacgttgccggcctactgtttctcgtccctttgggagatattatcgaaaacagaaaacttgtcgtggtatcgctcctactaagcgcagccgctctaactctgacagcatgtgtgaagcatggaacactgtttttagccgctgcgtttttcatcggactgggatccatcgcggcccaagtgctagttccgttcgcatcataccttgcaccagatgccgcacgcggccgggttgtcggcaatgtgatgagcggcctgcttctcggtattatgctttcccgtccgatatccagtctggtcgctgatatatgggggtggaatgccatatttgctttatccgccgcgttaagtgttgtcctggcaatcgtcttatcaaaagtgcttcctgccagaaaaccaacagcaaacacaagctacaccgtcttactcggttcaatgtggaagctgctgcgcacgactccggtcttacgccgccgtgccatttatcatgcgtttgtatttggagctttcagcttattctggacgactgtacctttactattgtccggtcctgcttttcatttttctcaaaaggcaatcgcgctgtacgcattagcgggcattgcgggtgcagcggctgcaccgataggcggccgtctggctgatcgcggcttaacccggcttgccaccggaatcgctctcggtgttgtcatcgtttctttattactcccgctcatgattcagagcagctctcccgtcggaatagcagttctggtggccgcagctatcctgttggatatgggggtatctgccaatctcgtactcagtcagcgtgccattttttcgttggcacctgaattccgcagccgattaaacggattatttatggcaatcttctttctgggcggcgctataggatcatcaatcggaggatgggcatacgcctcaggcgggtggagtatcacattatggattggaatcgcttttccggtcatagcattgctttatttcaccacggagaaataagcctttcaccaaaaataagccgtcaggaccaagctgacagctttttttggggtgtattcttctttacatccatccgaacaaaacatccggattcatgaaaagatgatattgattctttacgccccgctcatatagacgggcgcatgcccgctgccgattctttcagcagcggtaaaaccatgtcataatatgtttagaaataattgtccataggcaggtgaaacacatgaagaagtatttatataaacaccttttgttagctctcgtttcgtccgtttgctttttattggtcttttatgtgggtttaaaaatgacacaggaagacacacccccgttgtcttcttacccgttttacctttttatttatctttacatagcagccggatatttgacggtcggccttgtttcagcctgtatgactgatatcttgaaaaaccgctggacattgaataaaacgtcttccattctattgaaacttatcgtttacttactcataccgtatgctatttttcattctttcttcattttaatggcgccgttgatttatgtgctgttcgagtcgttattcatcctgagaaaagcttcataatcagaaaaaaacataccgcatgctgccggtatgtttttaacatgcttgtcagttttttgcggtgattcgtttgatgttttcttccatcaagccggaaatgagctgttcgtttgtatgaggaatctgtttgagctgttgtacgaccagcccttgtcttgcggctgaatgattttgactcagctttgcctgtccctctattttgctgattttgattttaaaaccttttacccctttgttcatgcctgccagcaatttcgcatcgacatcctctaatttgtacgggctgtcggggctttcgtatttcaatacgagatcactcatcgactgcacggtttcttcctcatccaaaagctccgcctctccgtaaacatgaaccgccacataattccatgtgggaacagcctgattcgtctcataccatttaggcgagatataacaatgaggcccctgaaaaacggctaatacgttttggccatcaatctctttccattggggattcggcaatgcaaaatgaccgtataagcattcgttattcttactcatcatcaatggcaggtgggttgcatacggcatgccccccgccgttgaaaacaatgctgcgaaaccatactctttgattacatcgcacgcttcagcttcactcagctgaaatggagccggaatatacatacaaaactctcctctctgaacatggattgataaagcgctttccgctataataaaatatcaactgacatttaaaaagatacagtttcaaataaatacacatgtcagaggagaacatctgatgaaaaatttgattttcgctttcagaagcggcaccccgaaatacaaacaaatttacgagcaatttaaaacattgattgagcaaggaaatattcaggcagatgagcggctgccttccattcgcgagctggcggattccctgcgggtaagccgcaatacaacgctgatggcctatgatctgcttttagcggagggatacattcgcggagaaacacgcaaaggatattttgctaatgaaatagaaccctctttatttcaacaagaacatgatgttgtttacgctgagaaaaccgaatcaactcagccggccctgattgattttcgcgccggagccgtcgatcaaaagcattttcctctgaaaacatggagaaaattatacaatcaagttttggcatcagagaaaagctttctgtacggtgaaccgttcggcgagagaaacctgcgtgaacaaattgccgcttatctcttggaatcacgcggagtgaaaacagatgcggattcggttatcatcggcagcagcacccagcagatgctgatatatctcagccagattctgaaagaggatttttccggaattatcgttgaagaccctgggtttgacggtgccagagcggcatttcaatttcacgggctatctctggaaacgatgcctgtctatgaaaacggagctgatttttctcaattgcatgcaatgaaagaaaaattaatctatgtgaccccatcccatcacagcccttacggcgtaagcatgtccattcagcagcgccaaacactgatcaattgggtgaatcatagagagggttatattcttgaagatgattatgacagtgaattccgttatacacagcagccgtttcccgctcttgcttccattcaatcagaccgggtgatttatttagggaatttctcaaaatcctttctaccgggcatccgcataagctatatggttttgccgcagcgccttttgcaccggtataaaaaacggtttattcatttcgaaagcaccgcttcttcgcttaaccagctgaccatggctgaattgatgaaggccggtgaatggacccgccatattaagcgcatgcgcactgtctacaagcgtaagatgcagcacttgacttcacatatcaagcagcagttcggcgatcaggtgacgatcatcggcgagcagtcgggattgtatatattagtaagagttcacctgaactatacagaagaaacattaatcgaacgcgcctttcagtacggagtgaaagtataccctaccgctgtctatttcgttgccggaaagcccgaaccgccgatcataaagttaggtttcgcccatctcgatacggatcagatcacacaaggcgtacagcttttgagaaatgcttggctgtcatgaaagaaaaaaggcgccgaacggcgcctttttttatcttttatttcgtatttcttgggaatttcggcagtccaaatataatggcggcgatgccgcagattccgattaaaacgggatagaaagagtatggcaggatgctgacgggtgaaatattcccgaatttcccggctgataacagctgcgcgccgtaaggaatcaatccttgtatcatacacgaaaagatatccagaatacttgccgattttctgttgtcgatgttgaatttatcagcaatattctttgcaatcggcccggctgcgataatcgagatcgtattattggccgcagccagattcgtcacgctgaccaatccggcaatgccggcttcggcgccttttttggaacggattcgtttcgtgatgaactccagtaaaaagtcgatcccgccgttttgtttcatcacaccgaccattccgccgatcagcatggacaggatgataaggtcgctcattccggcaactccatccgtaatcgctttaaaataagaatcaaacgtcaggctcccgcccgccaatccgatgattcccgtcaaaaccaatccgccgaatatgacagccatcacattaataccgattaacgcaaaaactaacacggcgacataaggaagcaccttaatccagctgtaagatgcagcatccgtatggagggcgtggcctgccggaataaaaaataagataataacagtcacaatggcagcgggcaaaacaatcagaaagttcgttttgaatttatccctcatttgtgttttttgcgtccggactgccgcaatggtcgtatctgaaataaaagaaagattatctccgaacatagctccgccgaccacagccgcaatcggtatcgcgctggagatgccaagctctccgctcaaaccggcgctgatcggcgcaaccgccgcaatcgtgcccattgatgttcccatcgatatagaaatgaaacaagcaatgataaacagccccggcagcaaaaactgctgcggaataatgctcaaagcaagattgacagttgaatgcaccgctcccatcgcctcagccgctgaagcaaaggcacctgccaatataaaaatcataaccataatgataatatcaggatgtcccgcaccggaagcgaaccattctattttttgattgagcgatttcttccggttaaataacagcgcaaaagctgacgcaatgatcgcggcaatcaagatcggcaatttataaaaatctccggtcaccagaccagagccgacaaaaagccctacgaataagactaaaggcaataacgcccaaggattcttatgattgttcatctgggtaaaccacctcttttcagcattaaagtcgctaatcacagtctaagcaacatttcacactttaaaagtctgcagtaaaaaagtcaagctgaaaaaaggataagtaatgattgataagatagaaaaagctgttttgtttcctctctttagaaaataaaaaaaaccaaggctcgtttcccttggtacatttcatgcggcccggcgcccgggacaccttctcttcattcagaaatacattcagctttcaatctgtttttaagtttcgcttcattttccaggatatcttcgtaatcctcaatcttcctgtttaatcgttttatggtttcatcaatttccctctgtttctccgtcagccttttcctttcatttataaggatgttttttcggggttcgatcgtatgatcggctccttcaataaataaagcggtatattcaatcagcgcctcaatcgacagcccggcacttctcatgcattttataaattgaatccaattcacatcatcttcgtcataatcgcggatgccgctttcatcgcgttttaccggaggaatcagtcctatactttcataatacctaagcgtcgcggctgataactcaacctgctttgcagcctgcgcaatcttcatattcttaccacccatccttcatacctttcataagcgtgccattatagaatatcatttcataaaaaaataaaccaaaccccttgacttaaagtccgctttaacatttaaagtaaaaccgaacagaggattcatcactttatcttggaaaggaagataaccatgtgcaataatcatccgactcgtgtattaagcgctccgcatgccaaagctaaatttgagcggacgacgattgagagaagagcattacggccgcacgatatcctgattgatattaagtacagcgggatttgtcactcagacatccacagcgcattcgatgaatggggcggcggaatctttccgatggttcccgggcacgaaattgccggagttgtggaagccgtgggtgaagaagtcaccacatttgccgccggcgaccgtgtgggtgtcggctgttttgtagactcctgcggggaatgtgaatactgcctgaacggagacgaacaatattgcacaaaaggcgttgttcagacctataataacctggactacgacggaaaccctacgtacggaggctacagccagaaaatagttgtcactgacagattcgttgtccgtattcccgatcagctggatttggatgctgccagtccgctattgtgcgcgggcattaccacctattctccgctgaaacactggaatgccggtcccggcaaaaaagtggcgattgtcggaatgggcgggctcggacatttagccgttcaattcgcgcacgctttaggcgcagaggtcaccgtcctcagccgctcaatgaacaaaaaagacgaagcgcttgaatttggagccgatcattactttgcgacaagcgatccggatacatttactgagctggccggacgatttgatcttattttaaatacagtatccgcgaaccttgacgtagatgcctacttatccctgcttcgcattgacggtacattggtaaatgtgggagcgcccgctaagccggactcatacagtgtgttctccttaatcacgggccgccgcagcattgcgggttcactcgtcggcggtattccgcagactcaggagatgcttgatttcgccgccgagcacggcattgctcctaaaattgaagtgataccggccgatcaagtcgacgaagcgtacgaacgggttctccaaagcgatgtccgctaccgtttcgttattgatattgcaactttataattctcataaaaaacataccaatatctattggtatgtttttttcagcccagattattttttatttcagcagccatccgggcaccgctttgatataaaccaattcaccgatcagctcaacaatcgtctgtgtgacgataacagcagcggctaatgaggcccaagcatccggcaaagccagcgctaacggaaggactgcgagagaattccttgtgcccgtgctgaagatcaatgctcttccttcacctgtatccagacggaacgcatatgcgataaaacgggagacaaacggcataatgagcaggaatagcagatagatcggaatcacacgtataatgatgtcagcatcattgatgactttgccgatttgtgtggcgacgaccgccaataaaaccagagccataaaaggaacaggcagccacgccgtccattccaacaccttttctcccgccggtttcttatcagcccataattgagtcatcaccgccgccagcagcggcaccgctattaacaataagaatgcttccagaaacggtcccgcatgaacagctcctatcacttctttcccgataaacagccacaggtataacggaagcaataccatctgaacggcgaacaaaaccggcgtggaagccagtattaatctctcatttcctttgccgagctgagtaaagacgatgacgtaatcaatacaaggtgtaagcaataccaaacaaacccctgataatataggaggagattgaggaaaaatggcggttaacacccatacaacgacaggtacagctaagaaattaccgatcagtaaggccgccataaacttgaggtttgacatggcttccctcagcttcaagaatgggatttgggcaaacatggcatacatgagaacagcgataaacagtgatatcgtccatccccagcgaagtcctgaatctttcccggcgatccccgctattcctccgatcacaagagtcacaccatatatccaaatttgctgtttttctaatgtctctctggttattttcattggctgacacctcttccccgcccattataccttcttttctgccggaattaaaaaacaccaagggtctgtgacacttggtgttttcaggacgtgttattgttgtcaaaaccgcttacgaaagcttatttgtgttctctgtcctgccaacgaataaggtgaccgcaacactcgctgaactgaccaaagtccccagaacggcagcaagaattgtcaaaaagccattgggaatcagaaatccaatcggaatgaggcccgcaaacgtgagaacgataaaacattgatagactccggatatgattctcacaaccaagctgctaaaaaaggacatgacgaatggcggaatgaacaaacataaaatgattccgagtgagatcaataaaatcataggctcgtcaaaagaaatgacacgattgccgggagactcttcagccgccgcgaatacagcaaatatagacatcatcagcgtaagaaaaacaagaaaaaaccttttcagcaacgttatgactccttttttataaaaacgggtatctttttttcaatcacaataaccattttatgttatcaaatgaaataatatgaagtcaaaccgagttctgcacctgatttatcggttcttatttttttgataatttccatataattgtccgcaagcagcatctatatcaatgccaaattgacttctgacggtcacgttaattcctgctgactttaattttttatagaagtttacaacttgtttctcatttacttcttcaaatctcataggtgaactaacagtcgggttatatctaatgatgtttacatggaacaagttccctctcttatatctgcttcttaaaagacgtactacttcattcgcatgatcaatagaatcattaactcccggcagcataatataagcaatataaacttttcttgaggtcacacgtatatgctcatctaatgtgtccattacctccaataacgggaagcgttcatttatcggcattaacttgcttcgctgttcattaaaaggagaatgtaatgaaaacgtcaggttgacctgcggataatcctgagtgatttttttaatgcccggaataatacctatggtcgaaatagataaccgacgagggcttaaagcaaacaactccggatttgtaagcacatgtaaagcatcaaaaacttgtacattcgctaatgcttctcccattcccataaaagaaatactatcaattgaatgtccttttaagtgaaagtacaaaatttggtcagtcatttcatctgatgttaagctgcgttttaaaccaatatctcctgttgcacaaaatgcacagccaaaatgacagccgcactgcgaggatatacaaaatgactcccagccagctttatatttcatattgaccgtttctattttttcgtctcctgaaatttcaaataagacttttgttacttgctcagaatgctgcacttttaaagcagcaatatttaaaattgactctccaaactcattcattaacaattttctcaaggatttaggaagaaccgttatttcattaaaatgatttattctccctttgaacacagcatttttgatttgattcattctaaaatcaggaaacttattttgtttcaggaactcttgaattcttatatacttgtttttttgttgcatgttttctcatccttccataaaactctggtttgtttgagtaaatagaagggagtgatcatctaacctttttttaaaatcaggcacaaaaaaacaccgacacaattatcggtgttacgcttaaataacatcatgcacaaataaacaaggacattatgtcattggattatcgtttatttgacatagagaaaaagcaccgataactgtttttgtatgatgatttggcttaaaaaaggacagactgctccctttatccgccaagatgtttccaatttttgcattttcaccatacaaaattccataaatcgttatcatcgctttcacctctttcttgtcaatattaacaataatcaccatatcataagggttcccttatgtaaagttaaacaaatgcttacgcccccgctaatgacagtattataaaacttgcttattaagcctaatccaagtacagaaagcgcgctgatcacatgtttcacttatccgcgacggaacatttcttatataatgggtgaccggcagctgcctgcttgaatcccaatcttcttatagtgattttttatattcatgacagtatgatgatttgtcacttcagcaatcagatcgtttattcgatccagattaatcggtttattttctgataagctgctgaagctttctctgatttcttcaggatagacatttccggccatgcttgacaggccgttacacccgttactcagcatcttcggaaattcaacgtctcctgccgcaaacaaaataaagtgatcagggaactctgtttgtttatgacgcagaacgtctcctccttctttcagcccccttatcccgggatgccggcttattaagtctttaagcgctttctcactcagattaaaaccggtccggccggggttattataaagcacagcctctttagaggtatgactgagaagttcgtcaacgtaataaacggcttgctgctgtgtcggtcttatataaggaggaaaaccaatcagtacagaatcaatattggttttctcgatgtgtttcatcagtttgacggcatcactggttcttacggctgaaacaccgaacatcagttcaacatcttcaaattttcgctgattaacatactcaatgatctgaagacgctcatctatgctgagtgaatgctgttcaccagtcgtgccgcatatgagtaacgaatggataccgctgtttttcaaatgttcgacaatagcatcaaatccttctaaatataaactttcatcttcatgaaaaggcgtagggatagcaacattaaaatttcgcatgagaatgtcctccaagtacatattcttgaatatctgcagagtatcatataacactgtctgacatttaaaaaggtacagtttcagataacgcaacatgtcagatgtaaagccgacacacaaaaaaagcaggcaaagagagcctgcttcatagcttcgtcttacagcggcccattccccggatggcttgacaaatatgagtaataaggcaaactgatataaaaattgtgctaatgaggtggggttaatgattttagatttaaaaggtgaaacgcacatggatcatcttgtgggaacgctgtattctgccgttaatgaaaatgacagccgcttaatatccattgtgtcagacatgtcacagcaggagattgattataaaggaccaaatcatcaaccattcaatggggaatatggcatatggcagaccataatagatatcatcaagctcatattcatcagcttcgcaaatggtatgaagagaaacagaaacttggcagttaaagccgcttattaggaggagcaacgataaattcattacaaatgtctattttcactgactgccaatcaattaaaatggtcagacaaaaatcgctattacatttgcaacgtatcttaatccggccggcgcagttgtaataaaaaaagaccgctttcccctcttcttcaacgtaactgacatcatcatcttcatttttcttaacataaggttcagcaaatcgttcctcggtatattccacacattgctttcaaatgcaggtgcaattctccttgaaacagcaaatggttgtttggtttattgaattctttcatattaaaaaatggagtcattttaatgatcatatcagtctccttccaaacgagattgcatttacccattatttgttattctgcaactgaatcattatcttttatatcaggaattcttacaaaaaagtaaggtaagtgtaaggtattcgcatttattcgatatgcagtgttcattagaataagaaatataaaaggagtgatgaagaatgaaaaacatgagcattttcattattatattaggctgcctatcggttttcatattaggaggctgcgctgatcaaggcgccgtgctggaaagcgattattacgtacaaattcacggaaaagcggaaaaaaacaaaaataatagcaactacgtttacaatttagaagggtataacgagaaaggtaagaaaaagatggtttctttctttgttgaaaagccttatcaagaaggtgacattgtacgcgttccgaggagctatgagggttataccggagaatctgaagctattaaggccgagaaactgcctgaaaagatcaaagaccgattcaacattgagaaataacagcgagttgagcagatatttaagtctgctctcaattttttacgacaggttcattcgaatgcaaaatgcaggatggctccttgggccacttctacataaaagattgtgcaaattaagcacaccctccccattttctttttttggctggttacaactatcggaagtggcattgacaattcttctatggtcccaagtaattaatgaactctatagtgggcggatacgtatacggcggggtttgcagttttttaacttcttgttatttgagctatttcgacttttacttgaaagaattaaattagagagtctgaacgaggagtgaagcacgcgctccatgtgaatccatttagttcaaactgaatatgcgcggactaaaatagttgcactgatggacgtattcaacacaaaaaagagcagtaaacacgtaagttactgctctcctcagtctatccgccgttcatttgttttacaatgtattcagcatcatttcctacaccttgaagcagcgctgaacctcgcctatgctgccaaggcaaaccaataaagtacaatccctccgcagctgaaacaccccggtgatgtataattcggccttccttatccaaaacaccttctattttcatccaccaaagcggattcttaaaaccagttgcccaaataacattgtttacttctaatgaagatgaatctttaaaaatgacttcattttgctttccggctatgactctttgttttaagatgatcttcttctgtcttattgcatgttttaattcatacccaaatatgaggtcgcctttcttttgaatgaacttgcctaatattgatgtatgacttgcatgtaaaactcctaatttatcaaaccaccaaaagatgcttctttttccaatccataaagggaaataaaccggttttttactgcaagccaaatatgtaactctttctttggataactcaacagctatctgagccccgctattcccgccgccgactaccagtacattcccaggcgccagttgttttgaatgtttatattgtgaagaatgtaattgacgaatatgaccggctacatcctttgatattgatggaatgttaggggtatgaaaaggacctgcggccaccaccagattcttcgtttgatattcttcccggtttgttttaattaagaaatagttgtttaatttttggacacttattacttctgtccgtaattggatcgggatttcaaatctttcaacatattttttcagataagcagcaatttcattttttgaagggagtccatgcttgtctccttcaagctgcattcccggcaaagagctgtacattcgagaagtaaataagaccaatgagtcataccggtttttccagctttcccccacttcatgacttttatctaaaatgataaacttttgtttcgacttccttagataatatcctactgagattcctgcctgaccggctccgattactatcgtgtcgtacatatgaatccccctccggttttatcttaattgtcagcagacaaagttagtccctatctcctcctttaatgatgatgatggtcacgcggattctcagtttgggcctgacaaagaatcgtattgtcgtgattatgcgctgccgtttccatttgaatggttacatgtgtaatgccttgatctccaagttcatgttcaattttgcgtaaaatactttcactttcagaaatggtcagctgatcgttaacaacagcgtggcaggaaagagcattcaatccgcttgtgatagaccatatgtgcaaatcatgaatgctttgaattccttctgtctcttcaattgtatgaatgatgtcagtgacatcgatattttccggagttccttccattaatacgtgaatggagtctttcgtcacatggtaaccgcttctcagcacaagaatagccacaatgacactggccactggatctgcccagctccacccgaagaagatgataaggatcgcagccagtatggcacctacagatccgagcatgtcacttatcacatgtaagtaagctcctctaatgttcaggttattctttgtatctccgccgttcagcataatccaagcgaccaatatattcacagctaacccgatgatacttatcgtcagcatgccggttgttgctatctccggcggatgagagaaacgtttgattgcttcataaatgatataaagggaaatcagtattaatgcaacaccgttgatcacagctgcaagaatttcaaatcgtttgtagccgaatgtcttatgatgacttgcctttttttcggccaatttaaaagcaatcagagcaaccattaatgagattgaatcactcagcatatggcctgcatctgacaaaagcgctaaactattggttaaaaatccgcctatcgcttctattatcatataacctgtaatcatgataaaagagatcaataaaaccttcttattggatccgccagcgtgattgtgattgtgacccataaaaatctcctccttatctaatacactgtatttattatttcttttctgctatgaagcattctaacacggacacaaaaataaccttatatgattatgtgctcatatatgaatatataggttctttactgaaatgtcaaaatattttcaatgaaaatgtttcttatcattagcttagcttgggaggttgcattgctatgaagccgcggattacagtaattactttaggcgcagataatttagaaaaatcgctgcacttctatcgggatggcttgggtctgcctacagaatacagaaggaacagccggtacagatttggacgacttgcaaacgggactgaaacttgccctctgggaccgcaaagacatcgcacatgaatcaaacgttacgataactgctcccgctcatgatactttttggggcggatacgccggtcacttccaagattccgacgggcacttgtgggaaattgtttggaatccgcactgggaatataagtgaataaccaacttttatagcaacaataaaaacacacctgaatgttctggtgtgttttttattttgtttcccacaacgatcaaactatttatacgatggcgggatgctttgcggaaaacggaatacattttcgggatcgtatttcgcctttattctttgaagccttgcaaagtttgagccgtaatatgcttttccgaagttctcgatattttgatccggaacattcacataagaacctgttacatatggtttcatcagctgacgcactctttcaactgatgcaagattcgaagcttcttgtgatttatttttccaactggccgtccattccgtataaaataacggacggcgccaatagaaggctgtttcactgcttggaactctgcttatcgcaccgccccaattgataaaaaagaaattggtttctgtcccagtcgctttttctaaaaattgtctcattactgcaataggttcttccggccaaagattgagcgcccacgccgaggagaatttaacactctgatcagacctgccgggaatcggttcatcaggatctaagaaatctatacaatccggatagtatagtgttttgattactgtttgtgccggcgttccggcatttaataaaggttttaataattgaatcagctccggttttgacccgaggaacaatccttccgcatggcacaaaccatttactttgctgtaaatctcaaggtagcatcctaatcgttcgtctgtaaacggtgcccatttttgccatgctttgaataccgtttctaactgttcccacggccaaataatattaaagacggttgcggttttaggggcacggtgaactttgaacgtatattgggtgttatatccgaaattgcctcctccgccgcctctggaagcccacagtaaatcttcattgcgggaatgatttgcttgaatgatcctgcctttggcatctaccattttcagtgcgagaaggttatcacttatcaggccgatcgatcgtgaaagcactccaaatccgcctcccatcgtgattcctccgattccgacggttggactgtctccgaacggggccataaaaccttcccgagctaaaccttttacaagcgggccgacgtgaatgccggtttgaacggttgccaccgcgtttttttcatctaagaaaacgttattcatgtcactcacatcaataacaatcccatcacttaccgtggaaagatttttatccagagcatggcggccgcttctgacacgcaaaggcacattcttctcacgagcccatttaatagcattacttacatcgtatgaattttgcgcaaaaacaaagacaagcggacagacatcaacataagggttccaattcttaaccgcctctgtatagccggggtcccctttgaagatgacacgtcccgttaactgtgctgatcccatctatttcactcccaataagcatttgattcccataccagtatatgtaggaattggacaaattcttagacagatgttctgcaaacttaaaaatagatacatatacgcgaagatgagaaaaaacaaaaaaaagacaagtgcggcaacctgccgaaactcttgtctctcctgccatgataggcacttacatttattggcgtgatatcccgaccaaactatggaagtccatagaacattatgtttgccctgccatgcgtggttctgctgagcaatctttctgtttgatcccccgacaagaatctttttctttatcgtttttgcacccctgtacggataaaatcaatacacattgaatcttatcttttacatgatgaaaagctcttattttttcttcttgtgcttacgtttgcaatcatgttttttctctttcttatgacgttttttacatttcgcttttgctttggctgctaattttgccgcttctacctttgcttcagctgctgcttttgctgcttctgccgctctggctcttgcttcttccgctcttgctatggcttcttccgctctggctctcgcttctgcttctcttgccgcttccgctcttgcatcgtcgtccgccatatcaaaatcatggccaaggtcacaggcctcgttgtatggctttttcttctggaagtactgttgatcgtcaccatcgttataatacattacgccactccttctctcattttttaatctctacatactatgtaaagaaagatctgcagcttggactggtattttgatgaaccggcacatttttagggcaattttcatttatcattgcaacagaatctggatgcctgcatgaaacttgaatgattttgacgattatcttaagcagcgtaaaaagggagactacgaaaaaaccaaggggttaaacccttggtttttttgtaaaaatgataaaaaggatgctgcacgctgcagcatccttctgtaccaactttttattgaacgattggaaagtattttttagcttttagtttgcttgctgtgtttgttttactggttctttgctaaaaagtccgacaatgttccacaagataatagcagcagctatgattacacgagccgtactgacttcttgattagtaaacaatttatagccatatattgatcccaatgctgctatgcaaaaaatattgaaccatttactccaacgcaattagaaaactccttataaaagattacatttccaaacaatatattataatattaacaaattttttcaatatttaaccttaaattattcttaagtggttttcctgatcattttctctaatcgtcattcgatctttcggagttttgatcgtttttttgttacaggctagacccagacatcattttcagctgtttgatcagttatttcctgcccggtattgacaacacctttaggttctgcaagcaaaatgttacactctgattctgcataaggtttatgttcaacatttttcggaatgacaaacatttcaccttcatttaattttacttttccatcacgaaattcaatgattaaattacccttaataacaataaagacttcatctgtttcgtcatgcttatgccaaacaaaatccccttgtactttaacaagtttaaaattgataatcattcatttcagcgattacttttggagaccattgatcttggaatgcagataatttctcttggaaattaatcggtttatattccattctttccccttcccgtgtaaaactcaatcatttaactagtcccaaattaaaggcctgtcaacctcagcagttctgaggtagtctaaaagctgaccggtatgtacagactcatggtaagcgattcttaataacatgtctcccagttcgcgaatatatccaacatcagacctgtcaatctttatatttgttaaatctgtttcgtttaacgatttgatgaatgtcaaaaacgcggcccgatacggttttgcaaattctaattcttcgcttactgtggtaaacgtttttgattcataaggattaatagtttcctctgaaaactcactcatatttttcattaaaatttgatgataaagaaattccgcttctaatacatgtcttatcatttccttgcacgacatggcttcggagtccgggcgccagtccattttttcctcaggtacagctgtccataacttgatgcttcgccgtcttacctcttcaaaatgtaaaacaataaggtcaattgtattcaagtattttcccccttttatttttaaataataattctccttcttcccggaaaaaacctcttcaaataaaaaacatatcctttcccgactcgccggattgataatcaaactatttttaagataaggagatattcattcatccatacaatagactctggctgaacatatactgaatgatagttttcatcagaaaggagaaatcagctttggcaaaatatcggatcatgacctttgacgggggcggtaccttaggtgctttaagtttacaactattgaacagactggctgaagaaaatccggcattaataagccgaacccatgtatttgcgggaaattcaatcggttcatttactgccctggcattagcaagcggaagatctccgaaggaaacacttcagtattttgaggatgaaatcctgcccgcattcagcacttcccggccgggcggacctgtttttaatcagcaattaccctattccggttttattaaagcggtacgaaactttttcccgccaggccttcgtcttaaagatgtaagaaaacgaattgttgtcccttcattcaaattatactccccggcactggatcgttggacgcccgtattatttcacaactttcccggctctccctatttaaatgagaaagtgagtgatgtcatactgcggagcagcggtgctcccgcgacacagcgcgcctatcaaaactacgtggacggatatgtagtggcaacgaaccccagtacggccagtatcgcgtttgcggttggtaaagccaacgtgccattggatcaaattgcggcgctatccatcggtacaggtgaagccccgactcggttaagaagagatacgaggggatggggaatggtaagtgcggataacatacgtcccgaaaatctgaagaaccttcctccaaattggggagtccttttggacaggtcgcctaatgaacctttactgccatttcttcagatgatctccggcggaaatggctactatgaatccatggtcagcgcgaatctgctgggagatcgctttttccggttagatccgcggattcctaacttctccaaaacagacccttccgtggttcccgctgtcattgaaattgcaaacaaaaccaacttacagcctgcgaatacatttatagagaaaaactggaacgacagcgctaaataagcaagaagtttacatcatcatacaatgaacaaaaaataccaagggactcaaacccttggtatttttaatgcgttcaatcgggccatttattgaatagaactgccccagaagtcgcttcccattacgtaaagaaagcgacttttagatttgattttcaagttccttttacaaattttgaaaaggccattgactattcagttgtactgtattaagtttaactatatagtcgaactgaatagaggatgaggatatgaaacataaattattaccgctgtctgaaaccatgcattatattttattagctctgcgtgagccgcttcatggctatgccgccatgcagaagatagaaaagatgagtaacggaactgttattttagcagccggcacattatacggcgcgattgaaaatttgaataagcatggctggattgagcctgttggagaatcaggccggagaaaggtttatatgataactgcggaaggaagcgccattttgaagatggaacaaaacaggttactgcatattttatccctgcacgaaggaagtgaatcgaatgaagaaatttaagatgttttttgatattgaaaaagaggagcaatggctgaacgagcaactacaaaaaggctatcgctgtacaaatatcagcggattaggaatatacactttcgaaaaaaccgacaaaaaatatgtgatgagactggattatcaagattgtttatcaaagaaaaaatttaaagagtacaaagaaatctatgaagacttcggctgggtttatataaacagcccatggcttagcggaactcggtattggcaaaaagaaaatgatgatcaaaatgaaatcttttcggatcgccaatcaaagagtaattattataaaagactaatggggttttcatcttgttttggtttactgtgcttgttttattcttatttgatttacaaggattcgggtttatatttaactgaaggtctgtggagtatggaaagcgcaatgttttggaaagcatttttatttgaaactccatttgccctgttgaggtcgcttcccgcccttatggctgttctatttggctgcagtttctataaaacgtatcgaaagtattcaatgttaaaagaacaataacacggggaagttacattcaaagaagtaattgaggatcatgcatctgccgaagccgggcgctttaaaggaaaaaaagcgccctgaatttgctgataaatcagatgacttattttgttaatgatacatacttatttacaatggcttgagcgagacaggctgatgaatcaacaatagtaagtccgcttcttttttggtccgtgaccatatttaaatccgtacatgcaatgataaccgtatcagccttttctgctaagtcatggtgtaattcatcatataatgtaccagcctcatcgatttgaccttgtttaattttttctattatttgatcgacatagatttgccaactatcttgatgtaaaaaatcataaccttctctgtttaacgcttcttgaaatattccggattgaaccgtaggaacggtggctaaaagagctgctttttttgagcctttaggtattttttttatggtttcatcaatcatgttcagtaaagggactgaaatcgatttttttatttgattaaaatagagatgtgcggtattacatgggatggcaataaaatcaacacccgttttttcaagctttacagcacccttaataattgcattttccatgtccgtatgattgagaggtttattcatgtagaaaggtgtcggacaggaataaatcatcatatgtggaaaatccgtgtcatgtattgctccatatattttttggcactcgtctacgactttatctacaaatggcccagtagattttggccccattcctgccagtattccaatcataattgtcctcctctgtaaaaatgtgtacgaatacgatcacgatgagttattcttgtgtttctcatctgaatctgctctcatttcttttctggctttcttctcctattttatcatttcattaattgaaaaagggctttaaaaaagatagctggcaaaccagacgacttgctttaagtaacggcgcagccgcaaacaaaaaataccaaaaacctcagaacccttggtatcattgtgatgcggctgagaggacttgaacctcaatgggttattcacccgctgggccatcaataaagtgaaactgtgttttctattacaaaacctttatatattagtgtgtgtttatattgatcatgttattttacaaagattaattcatattgtggagtaaaaatggagtcgtttttttcatcaccagaaagttacatgacatgtcttgggtgccatgtttgttaaaatcaccatcttcgttttaaaacgtacaggtttatagtgttccaaaacgctgtcctaaatgcaaaaaaatactggacgcaactaagtcaaatgtttttcacggtactatagtcaagacttgcccaagtcaccattatcaaaaagaattaataagaaaccaacgggtgatgaatcttttaatctttcattttacccgctgactcatatcaaaggagctttaaccaaattttaatagctgtcgcacttattaatagcgctaaaatccattgcaggaattttgtatttgctttttgcccaacagatgcgccaataggagaagcaatcaaactggcaatcataagaaccagagccggtgtaaaaagaacctggcccgtgattacttttccaactgttgcgccaatagatgaaagaaatgtaatcgcaagagatgaagcgactgtgattctaacagggatatttaaaatcgataacataatgggaaccaggataaaggcgccgccagctcctaaaatacctgatacgccgccaatgagaaacgctagggacgaagccaaccatttattagatatcacttcttcgtcttcgctatgttcttgtccttttttaggtataaacattaaaataactgctagtatagccagaattccgtatataaagttaattcctttttcagatatataatgagaaaagtaactccccaatacactccctaaaaggatgctgcttcccatgtacataattaatgctttatttaaaaaaccacttttacgataagcccaaacacccccaagtgtcgcaaagaaaacttgaatagcccctatccctgaaacttcatgggcagttaatgacatcactcccactaaagaaggaatgtataatagcattggataattaataactgatccgccaatacccatcattccggaaataaaggcaccaataaaccctataatgaaaagagttgtgataaaagcaatatccattttggttcctcctttcaaagaaaaagggcatctttgtattcgataccctttcacattcattagctttttttaatccagaattttaatacatcgccttcatcagtttgctctaaaagatcatgcccgcctgatttagaccaagctgcaagatcatttttagctcccttatctgttgcatgcacttctaatatttgacctgattccagttcattcatcgctttctttgttctgacgattggcattgggcatgccagaccttttgcgtctaatactttatctgatttcatgttcatctctcctctttttaatagaaacttgagttaccgtattgcacagcggtttggaccaatctccatttcacgctgtttttcttcatctgggctgattttccccatgtttgtttctcgaatctcttggtatgcatttggctgcggaggcaaatgatctgttactaagtgtctgaattctgtttcatccgcaatgttcaaaccatggttctcgctaaataatgtacttagttttttaccaacacttccatccttatttagctcgtcaatgatcataaagtgtgccggtaatacaattaaatcctgtgacaacgctttgtaacggctataaagcgttgttcttaaatctcctgcccaatcttctgccataccggctaagtctggtctgccaattgaatcaataaacaagatatcacctgaaagaagatactgatcatcgacaatgaaagaagtggaaccaatcgtgtgccccggagaataaatcggttgaattttaatctttgtatttccgatggtcatgtcgtttccttcttccaacggctgataatcgaataccgcttcttcagcatctttaggcggtaaccagtaggctgcttttgttttttcagcaatgactctgccgcctgaaatatggtccgcgtgaagatgtgtatcaaatacgtgagtaatcgtcgcactcttctccttcgcaaaatccataaagaaatctaccatacgcgtcgcatcaataatcgccgcttcaccattggaaatgaccatgtatgataggcagcctttaccgattcgaacaaactgatacatctcaccgccatcttttaaatccccgacttttaccggctctaaatgttcgctccatgctttcattccgcccttaagataggatacagaatgacctgcttcagaaagcatttcggataccatgacagatgaaccttcttttgcacaaacgaccagcacatctttatcagaaggaattttctccaagatatcttctacgccatctaaaagatcgaaatacggtacatttaaatggttaaaatcatgtccttcaatcttccaatcgctaaagtcattttcattacgtacatccaaaataaataaaggttctttgtgaaagattttttgtgtgacttcttttgcggtaagtgcttgcacggtcatgtttacatacctcctttttctgttttacctgtccagtcccgcataccgggaataacattaataacctttttaaaaccttgttttttcatggtgtgagctgccatttcacttcttcttcctgaatggcaaataatataaatttcatcatttttgtttaattcgttaaagcgcttttccacttcgccaagagggatatgcaccgctccggggatatgagcttcttcatactcctctatctctcgtacatctaaaatgtgaagagactcatcacgatccactttctgtgtgaaagcttctaatgaaatctcaggaattgaagatgcattttctgatgaatgctctcctccttttcgaagaaagtgacgaaggacttctccctctgtttcagtacctagatattcatggcctgagctttttgcccatgcttgcagatctgccgccgatcctttatctgttgcttgaatttctaataggtcaccagcttttaattcttttattttcttctttgtttttacgataggcattgggcatgacaaacctttagcgtctaatacaatatttgctttcacggtttttttcctccttttcttatataggggcggggtatataaatatgcaaaaagttattccctggatgttaataccatgtattcataccgccttttatatttgtgatgtttttaaacccttgtttcttcaatattttacttgcctttacacttctcattccgctttgacagatcacaaagacgtctttgtctttcgaaagttgatgagtttgacgaggcaagatagacaaaggaatatttttgaatcctttaatatgccttgtacggaactcataagaagttcgcacatctataaactgtttgtctttgttttccgcctccgattttaaatcagcagttgttatttgtttaacaccatgcaatgggaaaaaacgtcgaaatacgatccaaagtattgaacattactccgctattcatagtgttatatcccccttcacttattcaattgcaatggatcacattagataaataagttgacattgccttcctcagcgtctgccaaataagcagctacaccagcatagtcgatatcatctaatagttctttttcctgtaaaccaagaagatccattgtcatcgtacaagctacgagctttacaccttgttcttgagccatctcaatcaactgaggcaacgtaagtgcattatgctttttcatcacatttttaatcattttagggcccatacctgcaaagttcattttagataaacccatcttatcggcaccgcgaggcatcatctttccaaacattttttcaagaaatccttttttcactggaatcagctcttctttacgtaaagcgtttaatccccaaaaagtatggaagatcgtcacttcatgatcgtaggcagcagcaccatttgcaataatataggctgccattgctttatcatattccccgctaaataaaacaattgttgtgcgttttgtttgttttgtcatgtttattctcctgaccaatcactattacccctggggtatattgaaattaaaaattttttcgaaagatctcctattattcaattcaacatattaaataccggtaggggtatattataatgaatataaaaattcgtcaaccttaaagatgataggttgatgaatttttttatcggctctttaccaataagtcgaccgcttcttttactaagtgttgtgtgtcttctcccttttctaaactttcacgaacacaatgttcaaggtttgtgctcacaatcaaacccattgctcgatcgatcgcattacgtgaagcagctaattgggtcacaacctctctgcaatcttttccttgttccatcatggtcaatacaccttttatctgtccttctatccggcgtaagcgatttttaatcttttgatcatattccatgcgttgaactccttctttgaaatttatatatttgcatgttatccactatcatttcatactgcgctttatcacactacattattaactagataatgtttgtgaatcaatattatacccttacaggtatactgtcaattttcaagacggcatgagaatgattttaaagagttaatattagtatcccctgtttaatcacaagaaggcgctgaagttgtacgtgatttaatgcgtatgaagaaagagaaagcacttaattcaagcgaaaaaaatgttggataatgcatatgaatttttgattagtgaactggaagtcattaaaggaatcactgaaaaacaaataaaaagtttctgttaaggttaatgacagataagtttttcagagtattacgatcagacgttcaacttcttcaacttactttttaaacattaaccgcttttattactcctcaatctaatctgttatatttttttcttcaacgaacacttgaattctcgatgaaatagtcacttgatttttgtaatcctgattcaccctggcacggacaaggagccgtaacgatggaagagaggcagggctttcattgttttaggtctaagtgattatttccggaagaaaaaacaaccactctcccctttatctttcagaatttcttacatctcttgcgacagtgaatagcagttgtttatcttatttcataaaaaagatatgcgaattgtaacaaagaataacataccgttaccttgagaacataaaaacaaatcatttatatattccacatatcgtcaatccggtatgttatactgtaaacaatcctttgaggttttaaacctttttcttaccttgtagcatctgtccctactcgaacggtgagtagggttttttattcagtatgatacagagaacataaaaaaacaggccctatataaagagcctgtttgtataaacgattgaagattaagcagttttttgaacgttagcagcttgagctccacgagcaccttgctcaacgtcaaacgttactttttgaccttcgtctaaagatttgaatccgtcactttggattgcagaaaagtgtacgaatacatcgtctccattttcacgttcgataaatccaaaacctttttctgcattaaaccatttaactgtaccttgttccatttttgttgcctcctagtgtattacacattgtattactatccttgcccaaagtatcatcaagacgaaaagtcgatattcatactatcctttacacgaacaaaaataattctcctttatcatagcacgaaacggaaataactgcaaattaatatcatgtttcattcagggttttatttgttaaacgtgcggcaggtttttttgcgagaaccttcatttggaaattagaagttttgacggaccccttaccgtactaaataataaatatcatgttgagaggtgtatttttaaaaagcccactcacgaaaacgagtgggtttacaaaagctctaactaacccgcaaaggttttagtcagagctatttattttttgatccaactcactaagcgcctactctgtcatcagctcgataatattcattggaacgtgataaatcccctttttcataaaaataatcagctactctgattgcaaagttttcaatgtctccgtacattcttaggaggaagataccattagcgatgacgctaatggcgccctttgtttctactcagtaacttattcagcttctcccacaactgtaaagcgttcatttatatgttttggattttctatttcatccaatactgcaattgcatagtctgcatagctgatataactttcgcctttcgagttcacaagaagatgatcttttcctgactgataaaacccagttcttttcccgtctgggtcaaataccgctgaaggactgataaatgtccagtttatatcagaagtttcctttagctcttgcaagttacgaccttgccctttagctgttggaataaaaatctccgggaaatcaggtgtatccattacactgacagttttattttcgtctacataaagactccctgctccgcctacaattactgctcttgtacctattccttttaatgccctaattaatgcccggccagcatctacatgtgcctgttcttctcctaatggagctccgaaggcattaactattacatctaacttttttagatcatccgatgtaagatcaattatatttttttcaatgattgaaaccttttcctctttaagttttgcagcatctcttacaattgcagttacctcatggcccctgcttaccgcttctttcaagataagacttccagcttttccggttgcaccaatgattccaattttcaatttaaagtcctcctaatcattcaaaattttaaatgtaaccaaattgattacatgtaataattttagttacaccttatttgtttgtcaatacttttatcaccttgttaattgagcatattagagtgaaataaacttgtaatacattcagttacaagtgtactataaagagtgtaaagtaattaggatggtgaagaaatcatgtctattagcagccgttttgctgtaggaattcatatattggctcttattgaaataaatgaagacggaattagcacttctgaatttttagctggaagtgtaaatacaaatcccgccttaataagaaaaattatggggatgctgaaaaaagcaggtttagtaaatgtacggccaggtattgcaggagctgaattagcgaaggatttaactgaaatcaccttacttgatgtttatagagcagttaatgttgttcaagataaagaattgtttagtatacatgaaaatcccaatcctcaatgtcctgtaggccggaacatacaaagtacaattggtccaatatttgaaatcgcccaatctgccttggaaaaagctcttggacatataacaattgaggatgtggtaaaggatattatcgaaaaagaaaaaacggccgataattgttaaatgattcacagaaaatcttttatcagactggggataagaaaaatcaataaaacaaaaagggactggatcatattgaatccagccccgaattgatattgattttagatttagattacggtaagggatataaaaatgctcatgataaagagaaaaaattaacgacaatgcacacgatgccagattctttaatagggcgtgagtattactatccaacaactcaaggttcagaagctaagttcaaacaaagacttgaggaaatctcggattggtataaaagaaaccgcaaatcttagtttgaacgaatatgttctgtatataaaaataatgaggtatggagtgaattgataatgaattatgatgaaataaaagattactgcctaacctttccaaactcttatgaagaccacccttttggagatggttggactgcaattcggcacaaagggaataagaaaatatttgcacttatcttcactcgcgacgaacacttatgtgtcaaccttaaatgcgaacctgaaagggctgattttctgcgtggtctttttgaagaaatcaagcccggataccatatgaacaaggagcattggaatacgcttaccttagatgagggactcccagagcatcaaatccatgacatggtaaagtacagctttgaactgacaaaaccaaaaagtaaaaaggaaacataacatcgaaggatagaacgctcattatagatattcatccggtgcaatgatacagaggaatatgcaaaaaacctcaaggtagcaatttttaaattcgtatttacgagatgattttttcgttattgtgagtcctttgtttctcgacataggttgaacaaataaaaaaagagcagactcaaaatccactcaattaattaagatgattgctcatttcatccagacacctataaaaaatgaaaggtgacgatgatatgccgcaaaggtcatttagcgtttaattaatactgataactcaccttcaaacactttttcctctttctgattataggtagataacaatacagtaagtatccccgtctggcttttatttggttttttatcaataaccttaacaatagtgttcagtttatcattagggtaaacgggtgctaggaattttatattattcattcctgtcccagcaataatatcgtcttcatgacacccttcttcaatccaaagcttaaaagtaatagataacgtttgtattccagaagcaataattccattaaacctgcccatttttgctttttcttcatttaaatgcatgtactgtggatcatacacttctgcaaaattcattatattctcttttgttaattcaaaagatttagtttgaaaaacctgcccgatggtaaattcatccaacttcataaataaatctccttgaatctaaactttattattaaatctacgtagcattttaacatactggctctcacacaacaacttaacggtaaaacaattgttcccctatcaggaatgaacaagcacattgtttttgtttccttgcctttaacctctttataatcaggtgttttcttataaagaccaaggcggtcgccatcaccatcacccggcatatgtgccatttcctcataagaatctccaagcttctcataataagaataagcagtcagcctacgagaactttcttctggctgataaaacgctgaatatacttgccgtcatcatatacagaaattatggcgttatctcttttgtactcatctgaatctgctcgcatttcttttctgactttcttctcctgcttcatcacttcattaattgcattatcatatttactaccgccgcacgcagtcagcagaaggatgaaggtgactgacaaatcatacgacctactataagtaagtggacagtaacagatgaatttttataaacaaaaaataccaagggtgtcaaaacccttggtatcatagggatcggccgagaggacttgaacctccgcaggttattcacccgcttggcccgccatctatattcataaaactattgctcagttgtcagcatgtgaagtaaattacgaatttccttgttataacttttaatttcttcttcattacaaccggttttatcaaatactgcattaggtatcattgtgactttttctttaaactcattcccttcagttgttaacgtaataattacacttcgttcatcctcttttgaacgctctcttataataagacctcgctcctcaagtcgttttaaaactggagttaatgttccggagtccagatataattcttcgcctaaacctttaacagatattttttccttctcccataaaacaagaagaaccaagtactgtggatacgtaattcctaattcttttaagagaggatggtataactttatcatttcacgggaagctgcataaatcgcaaaacatagatgattacttaacagtaatttatcattcttcatgttaaattcctcacaatatttatattcattactacacataatagcataagaattacattaagggaaattgaatgactgacaatttaattaaccataacttatatacatggaaactttatttataaccaaaatgtgtttgaggtgcattcttattatgaccgatatagatacttccactatattgtttagaccgactcatagatttattgagccaccttctcaatatggttattatgtacactaactttaaactgcggaaaactgttctttattttagtctaatcattcatttagagaattttaattgcgaatttaaattgagagcaatttaatttcaaaaaatttaattgacaacgctgattagattgattaaaattcaattgtgttaaatttaatttataggagtgtttgatgatgacagtatattttacagcagaagctacaacaaaaggcggaagagaaggtcatgtaacatctaatgatcttattattgatttggatttagctatgccaaaaccaaatcaagtatccgcggctacaaatccagaacaattatttgcggcaggctattcagcttgttatgacagtgctcttcatttagcagcccagagacaacgattaaaaatcgaatcagctgttaccggtaaagtaagtttattaaaagatgaaagtgataatggttataaaatcggagttgttctggaggtggaaattcaaggggtatctcaagagcaagcggaagaattaacacatgcagctcatcaagtatgtccatattctaaagctactcgcggaaatattgatgtacaaatcattacaacagcaatgtaagacgaaagatgccaagatcaataggtaatagaataaaaaaatttgattaaaacatataggtgaccagccttcaaataaggagtgagattgatgttaaagaaagtacaattagaaaaagcagctcaagaatttgcagaagcaaccgcgaacccaccctatctattcgaccttggacctgagaaaggacgagaagctgtagatgaggttcaatctgccccaattgataaactgccagttgatattgaagatgttatgatttcaggaggaccgagcggacaggtatcagtaagaataatgcgcccgcagaatgcgcctgcgcaccttcctgtcatcgtgtacattcatggggccggctgggtatttggtaatgagcatacacatgatcggctcatccgtgagctagcagtcggagcacaagctgctattgtctttccaaattacaccttatctccagaagcaaaatatccgacagccattgaagaaatctatgcagtagtgaagtgggcatctgaaaatggccgtgagaacggcatgattcccgagagtctaacaattgcaggtgatagtgttggaggcaatatggctgctgctgtcacgctaatggccaaagcacgaggtgacttgaatatccggcaacaattacttttctatccggtaacagacgcttctttcgatacggaatcctatcaccagtttgctgcaggatactttttacgcaaggacgcgatgatgtggttttgggatcagtacacaaccaattcgaacgagcgtgctgaaattacagcatcacctctgcgtgcaactgctgagcagcttcaagggcttccatctgcattgattatcacagctgaagctgatgtacttcgtgacgagggagaagcatatgccaataaacttcgtgaagctggtgtttcggtcactgccgtacgtttccaagctatcattcacgatttcgtgatgctcaacgccttagctaaaactgaagctgcgcgcggagcaattgatctcgccgcaacctggctgcgtaaagggttttaatccatttattgtttcgtcacatagagactgctgcaaataaataaaaaacaaacagatccactcaaataattgagtggatcgtatattggaataatggaacttttgatgagctttttaatcgggctggttattattttgttgttgagatgtccctaattgaaaagctaactccacaacaaactccgttttttcaccagttcaccctcttcatatccaaaaaacctttgttgattagttagcgtacaagttctcgttttctgctttggaccccatacagaaaataaaaagccagctctccttcgggagaagaactggcataacaaagcttcttgcttcttattttgctgtattgcccggaccttttaatttctcttcgttcttgcgtcaatgttttattattaggacacaaccaataaaataatgacgatcgagaatagcaacgctgcatttgcaaagcagtaagccctccagaatataaaagagctgcagtcattgctgctcggataatcccagcttattctgagtctgtatttcgagtagtcggtcaattaaatggatgtttttttcattccttttctgtttgttccattttccaccacagtgaatcttttggattttcaacagcttcttgaaactcagctttagaagcaactgttgggtaagaaccttttaaagatttacctgaagtatctttaaataaggttaacacaactattaagccaattaaactgactgccaataaatagaaacccggcgccaaattgtttcttgtcacatgggttaaccaagaagcaactaaaggtgttgttccgccaaaaatagaaactgataagttgaatgtccaggataatgtacgatatctaatgtcagtatggaacaacgtaggtaaagatcctggcatagtaccttcgtatacagataatacaatacctaacattaaaagtcctataaataagaatgttatattccccatattaagaaattgaaaagagataattgaaaatacaattcctaatactaatccaattgttataacttttttatttcctaatttatctcccagtttaccaaaagttaaagcgaacggtaccataataatcaatacaattgctgtaaccggtgtacttatattatcacttataccaaggttctcatctaaataagaaggcatataccctaataataggtaattggttatattgaaaaatgccacaaatacgatacataaaaagatatcttttttatatgttttaatgacttctaataaacctggttgttgttcttggttttcagagatgtcactttcaaagattggtgattcatctagatgacttctcaaatataaaccaaataatcctattggaatacttaagaagaaaggaattctccatccccaactattcatttgaacatcagataaagtccagaaaagtactgtaactaaaacagaagctactatataaccagataatgtgccgatttctaaaccgctgcctaaccttatacgtttattatctggagaagattctgcgatatataccattgccccagcgtactctccacccacagaaaagccttgcagaatacgggcaaagagtaataatataggggcccataccccaatctgatcataggtaggaagcacaccaattattaaagtagataaagccatcattaaaatagtaattgttaatactattttccgaccaaatttatcacccattttaccaaaaataattccgcctaccggtctaagtaagaaggcaattgcaaatgtagcaaaagtaaatattaactttaattcatcgttttgaactggactgaaaaagtttttactaataataactgccaaataagaatataaagcaaaatcaaaccattccatcgcgtttcctatccctgtagcaaacacgcttttcttcgctttttgaatgtctacaacgttaatttttttcttgttaaacttcatttaataatatcgactccttaattatcaaatccacattatacaagcgcgtaaacggtccgagcatgcagtcccagaatgtatagcgtaatgcttctctaaaagtccgggggtttctgtttcacctgatggagagctaacggcatagtggctgattggttcaactgtaccttaaaagactagactaatatccatatcagcgccaaataacattgtaaaccaggaaagaaggatgaaattaagtgttttcgctggtttccttaacttatttttgccgattgggctaaaaataatacaagaagcaacaaaaagagaaacagccaacagataataccagcctaagcggttagtgagatatccttgggttgtggttggtattttctgcagacgatttggagaaatgattccccttcatacagctctattgtgaatatgatcacaatcgaaaaaaaacttttatttcttcaaagtagcctaaacctttattttagatcttccattacgtcttccaatatgtttattataagattgaggtcgttcctaagaattatttactgattctatctttattaccccacaatcaggtgaaacaaaacactataaacgtagcatacctttttaaaacctgacaagcccaacggggtgatagaaaccaggctaaagccaagctagtcaatggatagaagaaatttttttgtttttcccaaggaataaccgtctgcgtttaatctagcccaattagaaagaaaaagagcaggagtaatcctgctctttcattcaaaactttaatttgtatgacgaatttcgtataccttttcaactttctttaccttagactacaacagaaataagtagcacagggtatgaaataatggttttatttaaacagtcaatcaccgacaattgaatttattgcatgacacctgacaaaatttttttatccagctggaaataaagtaacattttttaaggtaatggatttatttttgttcaatgattaaatgatccccaatgacaataaagactaataattactaaaatttcaggaaaccccaatattgcttatcttaattattgtttaactaattggtaattgcaacagtaaacttatacttatggaaagttataccaaccgaaaattttccgactcaagtctgtttaaccagttgtgaaccaatgaattaaatacatcggtttgttcgatttgcaggttgtgaccagccatatcaagtactgcaaaagttgcccttgggtaatcttcgagtagccgccacgcatcatggtatccgactacattgtcctgacgccctgtgataattagcgtgggataatcaagtttagatgaaatatcgaaggtaaacccatatccattttgacgaatgttgtttacgaattcataatttgtttgtttagatggaagtaaaatttcatcccgaaacctctcccattcagttttaccttgcacaatccccatagagcaaaattcattcgcctcctctgaagacaaatgtgatatcaagtcgctgtctctttttagaacagtcttctgcggtactaccctttcatcgaattcgggtatagttaatggtgccatcagcagtaatccacgaactgtttccttacgtgaacgaacgatacctctggcaatgtaccctccatatgaattaccgcaaacaataaactgttgatcaggaataatctcgtccaaaagacgcaatatcgcttctaaaacatcatcagagttctgaatagatggttgtggcttagaatgtcccatacctggtaagtctatgtatattctcttccaaccgcttcgtttctcgaataacggttccattgcatttaacatcacctgatggtcaagtgtccaaccatgcaacataacgatcggatatccatctccaattactttatggtaaatcgacatgtagttgttccccttccctgtaatcctaatgtttcgacatgaacatttaatcctttcatacatttatcacaattttaacaaacttttaactgaacttggtaagttgaacaagggttatacattgaatttcgacaatcgcaaactgtcatatgtgtccgtcatatcaaaagaatctgtttaatgtgttgtttagtgctttcgttactgcgactatcgacaaataagaaccaagcaaagtattgtccagatactttgagtattttgatcactttgaactttaggtaagtgggcagtttgtgggcagtagatcatttaaaaataagcgcaaaaaaataccaaggatctctctattacccttggtatcattgggatgcggcgagaggacttgaaccttcacgggttattcacccgctgggccctcaacctagtaaaaacctatcatgagtttcaaaagcttttattcaaagcatctgtttattttatttatacttattttcatcatttttcatgaattccgagcacaaactgggcacctattagagaccaaggaaatctacatttcaacaagaaatatctactcatcgccctgctgtaattagtttatttcagcttccctcgcgaataccggatcaatgctcagctttaagatagtcaaccaatttctccgcactgttcttaacatcttcttttgaaaggtgaagtgtaccatattgtgcaaaggcaggaagaaaacgcattcctatatagttagcagtgatttgaaacggtctgataagctcgctgatcgtgatattatattctccgcctgcttgataatcagattcctgtgcgcctaaggagatagctaagagtagttctttgccatgcaatttagtacctccagttccataagcccaaccatgtgttaacacatcatcttcccattgtttgagtaacgcgggactgctgtaccaatacattgggaactgaaaaacgatgcgctcatgatctaacaggagctgctgctctttttctacatcaatgataaaattaggatattcaccgtacaggtcatgaaccgtaatgtcattctcttgctttaaacgattcatccaggttttgttgacaacagacgtttccaaattagggtgtataacgataactaatgttttcatttgactgattatcctttcttcgccgattagttattattgcttttacgataatgaattgaattaattttaaaatatcaactttatttacacctattttatcctttttcgtgaattcagggcaaataattgggcaccgattacatttatagccaaaaaaagacttaaccttttaaaaaagattaagccttttcagtacctttatgcccctaccctattatctcgtgtctaaattctaatagctgataatataacaaggcctctttgttttcctccatgcttagcaatactttctctgccttttgcaaattggagtttgaggcattagtaactacctataatgatgaaaatatttgtgcgacgtcaactgtagatgacttactccaggtaagtgggcagtttgtggatagtagatcatttaaaaataagcacaaaaaataccaaaggcggttaaacccttggtattattgggatgcggccgagaggacttgaacctccacgggttattcacccactaggccctcaacctagcgcgtctgccattccgccacgaccgcgtgctatgaagctgtctttccactaagcatataagctagtgatgatgatcagcactttgaaaagaaagtgcgggtgaagggactcgaacccccacgtcgtaagacactagatcctaagtctagcgcgtctgccaattccgccacacccgcgtgacaagtggtgagccatgaaggactcgaaccttcgaccctctgattaaaagtcagatgctctaccaactgagctaatggctcgctctaaaagtgattcaaaatttttaaataaaatggctgggctagctggattcgaaccaacgcatgacggagtcaaagtccgttgccttaccgcttggctatagcccaacgaaggtaaatggtgacccgtacgggattcgaacccgtgttaccgccgtgaaagggcggtgtcttaaccgcttgaccaacgggccgtctggttgagaacttatctggcggagaaggagggatttgaaccctcgcgccgcttacgcgacctacacccttagcaggggcgcctcttcagccacttgagtacttctccataatggctccacaggcaggattcgaacctgcgaccgatcggttaacagccgatagctctaccactgagctactgtggaatgatcagactttctttattataaatgatgcgacatattgtgtcaataagcaacatttattttttttgagaaagcatcgttgtctctcaacgacttttataatttaacacagatcattgaaatgagtcaagcctttttaaaaaattcttttgatttttcctctgcactttccgcaggcatatctttccgggttcattgcccgcttctttatatactgttggccgcaggcctcgcatctatacatatatgttttcttttgtgtctttttggtttgcagcggcgtgcagaatcttggcgctccgactttctgaagcaggtctctgaaatccttgtctctgtgcttgtacccttttccctcaagatgaagatgataatggcacagctcgtgcttgatgatgcctaccagctcgctccgtccgtgttcgagcagatattttcggtttaattcgatgttatgggaagacagcatgtaccggccgcctgtcgttttcagccggtcattgaaaaaggcccggtgacggaacggctttccgaaatcctgtgcagagatgtcttccgtcagcttttgaagttgttcgttatccatatgtgcaccccgctttaaaaacattgaacgggacaattcaccgttcgcatacaatgtgttaaaaccgacctctaactaaaagctgaggaggaatgagccatgccgaattggctgatgaaacaaatgcaaaaagcgtttttagaaaaggacaattaccaaatcaaactgctgaaccagtgctggtatttctacagaaaaaaacactgctcgtaagcagtgcttttattttaccatagacagcgacactctgcctttttgcacgtccaccccttcgacccatacggtgacgatgtctccgaccgatacgacgtcgagaggatgtttgacgaattgattgctcagttttgagatgtgcacaagcccgtcctgcttgacgccgatatcgacgaaagcgccgaagtccacaacgttccggacggtgccctgcaattccattccttcctttaaatcctcaagctgcagaacgtcttttttcagcaaaggcttcggcacttcgtcacggggatctcgctccggccttgtcagctgcccgcaaatatccgcaagcgtaatctcccctataccgagctcctcagccgtttcagacagcggcagtgcgctgattttctcttttacgtccgcgcttccgatctgatccgcagtgagctgcagttttttgagcagcgcctttgtctctttatagctttccgggtgtatcccggtgcggtcgagcggctcccgtcctccgggcactctcaaaaagccgatgcactgttcatatgtttttgcgccgagacgcgggatatctttcagctctttgcggtttgtaaattttccgagctcttccctttttttgacgatattgccggcaacggttttggataacccggctacatattgaagcagcgcggctgatgctgtattgacattcaccccgacttggttgacgacggtctctacgacaaaacggagagattcgtttaaatgcttttggctgacatcatgctggtattgcccgacaccgacggatttaggatcaattttcacaagctcggccagcggatcctgcaacctccgcgcgatggagacggcgctgcgctcttcgacctgaaaatccggaaattcctcacgggcgatttctgacgcggaatacacgcttgctccggcctcattgacgatgacataataaatgtcccgctctgtttctttcagcacatcaacgacgaattgctctgtctcccgtgatgccgtgccgtttccgatcgccacaacctcgacttcgtaccgatccagcaattctttgattttttttcgggcttccgctgtctttttgacgggagcgtgcgggtaaatgacatcgattttcagcacttttcccgtctcatcaacgactgccagtttgcaccccgtgcggaaggccggatcgacgccgagcacgacttttcccttcatcggcggctgcagcaggagcttacgcaggttttcagcgaaaatatggatcgcctgcgcgtctgctttttctgacagttctttgcggatatcgcgttcaatagccggctggatcaggcgtttataactgtcctcaatggcttctttcagcgtttctttcacaggtgtttcacggtgtttgatgatttgcttttctaaataagcttttatctgatcggcgggcggttcgatcgcaatctttaaaatgccttctttttcaccgcggttcatcgcaagcactctgtgaggaacgaccttttggatcggctcttcgtactcgtagtacatctcatagacgtttttctcgtcatctgcggctgacttgcctgccgcggaagtgagaattccttttttatacgtttcctggcggatccactttctgaaatgaggatcatccgagatttgttcggctatgatgtgcttcgcgccttcaatggcttcctctcttgaagcgacttctttttctgcactgatatattgatcagcgacgtcgtgaaggcggttttctttcgggagagaaagaatatagtccgcaagcggttcaaggcctttgcttttggcgacggtggcttttgttttccgtttttgtttgaagggcggtataaatcctcgacttcctgaagcttgaccgcttgctcgattttttgcttcagcccgtctgtcagcttgtcctgctcggagatcaatctgatgacttcttctttccgctgcgtcaggttttgtatgtattgccaccgctcggagattgcctgaatctgcacctcgtccattgagccggtctgctcttttcggtaccgcgcaataaacgggacggtattgccgtcttccagcaggcggatgacactttcgacatgtttttgggataacgctgtttcttcagcaatttgttttttcaaaagggctaacgtttccatatcacaaaagcctccatctcttctttctttctctagtgtatcaaaaaacggcggaacataaaaaaagcagccttacgataaaagctgcccgagaatataggtcaaatcatcacgtctggatgttgtgtacggatgaagtgattttgatatttcttctattgagtgtccctgctttaagcaggtgcggatatgcggaacctcaagcccatccgtgtagatgatgaatgtcgcccctttttcgtatgatgacgtatacgttttgtatctttgcggtttgcctgagaggtaacccgaaatcggcagcggatgaaaaacttcgcctgatggggagtgcaggaagaaacggacgttgccgatcgagcagtatgtcaattcccttttgatgaaattgatttttaagatggaggcagtcgcccctcttttgtttttcatcgcttgattgcagcgctcaatgatgctttccacatcctcatccgcatacgtttccacgatgtctttaatggctgacgaggattcattggcaagagatccgctgccgagaccgtccgctaccgcgcaaactaattcttcttcattcgccttcataaaaaagctgtcgccgcatatggacttgccttctttatttaattggtatacaagagtttgaacatgttcattttcttcaacctgaatcattacattagctccatggagggatctccaatcaaggcctctctcagttttttcaccgctttccgctgcaggcgcgagacgtgcatttgagatattccgagaatgtcccctgtttctttttggcttttattttgcacaaatgttagatcgataatctgtttttcgcggtcggacagcacatgaagcacgcttttgatcatcatctgctggttgacgcgttcgtatccttcctcctgcgacccgacgatatctaaaattgtgacggtgcttccgtccgcatccgcttcgatgctgtgatcgacagaaagcgcctgatagctttttcccatctccatcgtttcaagcacttcctcttctgacacatcgagaaaggctgcgatttcttcgactttcggcgaccgctgcgtctctgtcgtcagctgatccaccgccattttaatgcgcggcccgagttctttaatccgtctcgggacgtgtacgctccatgttttatctctgaggaagcgtttgatctcgccgatgatggtcggaatcgcaaatgcttcaaaggatttgccgacctcgggatcataccgtttaatggctccgagaagtccgatcatcccgacttggcggagatcttcgtgaaagctttttccttttgaatatttctttgccagcatttcgacgagattggtatacacctcgacgagtgtttcctgggcttctttattatcatgtgtttgaaagtcgcgtatgagccgatcaacttcatctttagttagtttcgtagtttttgatggttgtgccatgatcaactcgctccccatttaaatactttgtcatcgccacggttacgccagagttgctttgaactttgacttcatccatgagcgtttccattaaatacagaccgagccctccttctgacaattgatcgactgtgtgcgaaggtgtgtacggcccgagatcctgctgcttctgatcaaaatcaaagctgtctccctgatcggcgacaatgacctccagccgatcctcaaacacaccgaaccgcacggatacttctcccttattttcatctttgtatgcatgctggacagcgtttgtacaagcttcgctgacagcgatttttaaatcttcaatgtcatcataggtatagcccattctgctggcgactcctgataatgtaagcctgacgattcctacatattccggttcggccggaattttcatctctatataatcaactgatgtactcattgcacgccaccttctgactttgccgaaatgtcgatgatgtccttaagccccgtaatttcaaacagacggacgagccggtcggaaagattctcaagcttcagagagccgccttccttgctcaccgttttaaacacgcctacaaaaacacctaaacccgtactgtccatatagtttacatcttttaagcagattctcatgtccttcccctcgtttgccaggggcatcagcttttcacgaaccaccggagctgagtatacatcgatttctccagcgatattgatttgtatatctgaaagattctccttcatatctaccgttaaattcatcgtatcacctctgaaagttatccttactcgtgctaatggctttttacccgtgctgccgtttttttaaacctttcttttcaaaacaattaacgtaaaatcatcatgaagctgaaagtcctgaagtctcagcaggctgtcgtaaatatttttgaccatatcctgcgcggagcagtccatatgttcttccagcatgcgctgaatgtcgctgcgttctaagaaaccgttttcggtacggcattcggtgacgccgtcagaaaaaagaacgatcatgtctccttcgtccatgtgctgttcatattggctgtaatcaaaatcctgggaaattcccagcaccaatccttttgcctccagatcataaaactttttttctttttcagagtagtagaagcccggttcatgccccgcagaagcatatgtaaattggtgatttttcgtattgtagtttgcgtaaaacatggtgataaacatgcttgagtccacgttctgttctacaacgcggttaagatttttcagcacttgggaggggtgaatgccgatctccggaagagagtccatggcatacttgatcatcgacatgcacaatgcggcgggtattccttttccgatgacatcggctatcgcgatgttaatcgattccttgtctttgacaaagtgataatagtccccgctcatttgcttggcggggacgctgatcgccccgatatccagttcttcttcttcaggaatttttgtgcccagcagcgtctgctgaacatttgcggcaatttcaatttctgaacgaagctcctgctggatatctctcagactttggtgttcctgataagccatcccgtagccaatcatgacttctattaaaaaatccagcgaatgaaaaacatcttccggcagatccggatacagttcctttaccacttttcggtggatgctgatgatctcctccggaggaacctgatgttcaatcgtttttcggctgaatttttgggcttgatataaagatgtttctgttaattcggctatatatcggctaagcagctgatgataccgctgctctataacctccctgaaatccacgttctaacctcctaccgaagccattttacggcttgaatctctgttccttcctctgcaacagattgcaggctgaattcgtccatcagccttttcacgcccggaagtcccgctcccagtccgcctgacgttgaaaagccgtcttccatcactttacggatgtcggggattccgggtcctttgtcttctgctataattttaaggccttttttccctctgtcgtttacttgttctatgctgacctggcccttgcctgcatataagtaaatgtttctggccaattctgagatagccgtcgtgattctggcctggtccaccgtgccgaagcctaattccttcgcaacgttgcggccaagctgtctggcggctacgatatcccattctgtcatgattttcacacaggattggtcgttcatcgctattcccccaattcccgcttcaatgtctcaagcccttgctctaaatcgagcgccgtttcaatttcctcaagtgagattccgagttcaatcaatgtgaccgccacagccggctgaattcccgtcaatacgacctttgcgcccatcaatttagacatggtgatgacatcgccgagcactttcgcgataaatgaatcaatcatgtcaacggatgtcaggtcaatgacgaccccgtttgcgccggtttcatagattttgttcagcagatcttcttgaaaatgcaaagctgtctggtcgtcaagctcccattggatggataccaataagcagttatacagtttcaggatcgggatttttggatgtctcacaatgttattcccccaatgaaacgatttttcgatttgtcatttcaagcgctgtttgaattcctttttgaagggtattcttcgtaataacctgcgacaaatcaattcccagattaacgatcgtctgcgcgatttccggacggattccgacgagcagacatttcgcgccgacaagccgcaccgcttctgatgcctgaataatatggtgcgccaccatcgtatcaacgaccggcacgcccgtgatatcaattaatacaacctgtgaacggtgctttacgacgccgtttaacagattttccataatatgctttgcacgctccgtatcaatcgtcccgacaagcggcatgaccgttacatgctcaaataccgggatcagcggagccgacaattcctgaagcgcgattttttgcaaagtaaccgttttttcccaggagatagaatactgatttaagatttccgtgttgatcggattgaaaaagctgtctatttccaaaatcaaatctgctctgtcctgatcggccatattaaggtcgaccatcgtttcgtaaagcagtttccaaaactctgacagggtggctgaaagaagtttcagcgacaggccgagctgaacggcgcgcagtgcgagttcactgatctgctcttcggcagcctcgtcattttttgtcgataataaaagaatgtctatataatctttacaaatattttcacatatgtgattcgtaagctgatagtcttcctgattgcctacttcttttagtttggctgtccaagtatcaagcagttcatcatgctgatcaataatgaactgatacactttctgattcgacatgggtttcactgacctcccgacacaaaacaacaaattttgtttgattatttctttattatagcgcttatgtttttcgaaaacaaaaaaagttgctctatatgagcaaccaaaatatgactaaaaatcaatgagtgccaaactgatttgcagggcttcatcaaccttatccatcatttcatcatccagatgagttattttatccgttaatctttgcttgtcaatcgtccgaatttgctccagcaaaataacggaatctctttcaaaaccgtagcgttttgcatcaatttcgacgtgggttggtaatttcgctttctgtatttgggctgttatggctgcaacaatagcagtcgggctaaagcgatttccgatatcattctggatcactaaaaccgggcgtacgccgccttgctctgagccaacaacaggagataaatcagcaaaataaacatcgccgcgctttacaatcaaaatgattatcctccgctgactaagcgctcaacggtcgtttctgcttcgcactcagcatagtgagcctcagaagagatattcaagttgattttcgccatttccatatacccgcgtctcatcaaatcacggttatggcgagttgtccgttcgctgacatacgctctcactgcttgtgatatcagttcgtttctgcttcgtttctcccgcatcgctacaccatccaattcagctactaagttttcgggcaagctgattttcatttcggttcttgcgctggattcagacaaaaaacatacacctccaccaaacttacggatacgaccaattcatccatccagacataatgataccattattcaaacgtcaagcaaagctgttttataaattctctttttccggatgacggctacttgtttgtattatcttgcagtaaaggatttcttacttccattatactctcattttccaaaaacatacggggaacgcgggaactaatggtacaagggacctcgtaattaatcgtctcaagccgccctgcgatttcatccatcgtgatcgtttcttccttctggctgccgatcagggtgactttggtgcccggcggataagattgatctaattcgaccatcaattgatccatgcagattcttcccgcgatgttcatccgtttgccgccgatcagcacagacgtgccgctcagcttgcggagccacccgtctgcatagccgatgggaaccgttccgatccattgatccttctctgccgtatatgttgcgccgtagctgacgctttcccctttgcggatctttttcacatgggataacacagagtgcagcgcaaaagccggctttaattgaaacggaatttcgctttggatgtcagcagaaggacgaagcccgtacatactgatgccgaaacgaaccgcgttaaagaagccttttttaaggcgaagtccggcggcgctgttcgcgcagtgcaccatcaattcttttaaagggagcggagcgatcaatgttttaaagcggtcaaactggaagaggaaataatctctgtttttctcatccgcggtagcaaagtgggtgaaaacgcctttacagactaaaccgggattttggctgaggatttttaacacgctttggatttcttcctccgttttgactccgagtctgttcatgccggtatcgactttcagatgaaacggcaatgtggcacctccgaggtggcgcgcagcttcctgaagccattcaacagaatatcccgtgagtgttacgtcatattcggcagctgcttgtacatattcgggcggcacggcgccaagcacaagaatcggcgctgtaatgccccgttttctcaatgaaatcgcttcatccagtatggctacggcaagacaagaggcacccgcttcaagcgcggctttcccaacttccaaatctccgtggccgtaagcgttcgcctttacaaccgccatgagatggacgttttgcccgatgtgttttttcatatgcgtgacattttctttaatcgcggacaggttgatttccgcccacgtttctctgtaaaaggatgctgtgttcattcgatacacttcctagcattattttcaattcatattgttattatcatactaaaattattctgcaaagtgaaatggaatcaaaaaagagaccgacagcggcggcctcttttttgacattattttgacgactgtccctgcatgcttttggcggcggccaccatttcatcctttgtcagatcctgtgatgacagaagataatccactccgtcatatgtccacgttaaagacgtatcagataatgcggccaccgtgaagccgagattaaccggttcgcctttcagcgtgacggcagaggcggcttttgcgatatgggctttttcttgaataagggtgaaggatttttctccgccgtaagtcatgacgatccgtttgccgtccgccgttgaaatatctttctcttcaagctttttgacgccggccggcacttgaagcggtgttttgaccgcaaatgaatcagacggcttggcgcttgtggcgacgtccatctgggaaagcgtcatatttttcttctcgtcaaaagagtctttatcaaacggcttgttgaattcaaagcttttgaattcgacttttaccatcactttccggtctgtatccatgactttgacgagcgaagggctcatgtcctttttgttgaaagtgatttcctgagtcggcagcattttgttgtgctgatagtttgtttttgtttcaaacgtgtactttttatctttggcggaatagacggcgtctttgtcatgctgcacgtcctttacaagtgactcaaacaaatatacttggctgctgttattcggccagtcgctttggaacctgaagctcttatttaaagacggcgtaaggacaaagactccgttggcgttccgtaaaatgacttggttttggtcttttttcggattttccagatagacccggtacagggaaggttttttatgccagatttccacattgtatacttgcggatcactccccgtctgaatggtcattttggctttcgctttgtacgaggtgtattctttcgccttcttatctaaaccgttcacgatatcttcctgtgatttttggccgcaggccgaaagaataaggacggcaagcagtcccgttaaaagcaaaacaaagctttttctcaccttttttcaaccccttcttctcaattgatgtaaagggaagaaatcgcttgtttgactttaacggtacgccctgaacggacggacgcgtaccataaaagcctcaaacaacttgtctcccttaatgcactatcaaatatatgaaggggtttcggctaatatgcagactagcgtgacaacctttcaatcacgacctgtgccgcggcgtattcttttgtatgggtaatggagacgtgaaccgccgcgccgtccagcttggcgcaggtcagcaccggcttgcccgccgtgtcgtttccggtttcgatatcctgaaagctgagctctttgccgatacccgttccgtatgctttcgaaaaggcttcttttgccgcaaatcttcccgcgagaaattcaattttccttttgtccgacagcaatgtaaaacgggcgtattcagcctccgtcaatattctttgcggaaacctcgcctgccggctgagcatgttttcaattctgtgcagttcaacgatgtcgattccgattccgaaaatcatgtgaattcctcctaaaagtccgtactaaaaaacggtttatgtcataaacgtgttactatatatgtaacaaatcagatgcaaaggggcttgcgatgtttatacgtacggaaaatttccagacttttatcagacgttatccggccgtcagctgtatcttggcgctgcaggcgttcttgtggctgtttttcagtatgccgcttcattccgtcatgatgtggtcagatgcagtgaccggctataattacggcgtttcctcgggagaatggtggcggctggtgacaccgatgtttttacatgcgaatttcactcaccttttgtttaactccatgtctctctttttattcgcgcccccgctggagcagatgctcggaaaagtccgttttttgattgtgtacatcgcatcgggcattatcggcaatatcggcacatatcttgccgaaccgcttgattatgtgcatgtcggcgcatccggcgcgattttcggacttttcggcgtgtatgtgtttctgactgttttccgcaaggagctgatcggccgggaccagtcgaaaatgattatgaccctgcttatcatcgcggtactgtcgacgtttatcaattctaatattaacattatggcgcatttgttcggactggcaggcggatttttgctttcctttttatgcgtgcagcaaaaaaagcggcggtattaaccgtccgctttttcatatgaataccagcgcccgatgcgttcggcatcttcctcgctgacatccttcagcatgacatgctccatgtggtgagctgatttcactgcggtagccacagatgcgagccgccttcttttttgcagaaaggagcggctgacttcaaacatctgcattcttcttctcagcataatcgtggtcgtcttcccgatcagccgtgtggtgagctgcagccggcctccgtttaagcaccatgacgcgctcttaaatgaggcgtagcccagcaccagttcgacgggaagcacaaggagcgatgcatacccccacggtttaaacagaatacaaagcggaatgatcacgaaaaccgagaagataacggagcggaataaataccggcgcagcgcccttttcggcaaatgattcctattttcttccagtacgtaatccggtgtgaaaccgttcagcatcacaccgagctttgatttgcggatgatcggaaacagaatcgtctgagctccttctttctcattccccgcactgccggcgctgacaatcgcaaccgtcgcgtatccgaataactgcctgatcacattttctttaattttaatggcttggattttacggagcgggatggtcacttgatgtttttcaataattcctctcgtaatgaccaattcgtgttcctttttttctatcttaaagttggcatgcttgatcatcataccggcgatgcttaacagccaggcgatgaacaatcctataaaaatgatcacggcgtatatgccgatgctcgcatgcttgagaaaagaaaacctgtcgtagaaccagtccatcggaagtacttcatcaagctgagaaaagagggcgaataccgctgagatgatgacaccgatccccccggatgttgaggcggccataagcagctcacccacagacaggcggtaaacggattgcacatcttccccgcgcatcggctcctgctccgctgcggtctcccctcgttcttcttgctccgctttttgctgaaaaacagccgctctgatccgttccgcctcttccacagtaatggcggataagacggcctcggcgtttttcccgtcgccggccgtttcgatttgaagcttaacaagcttaaaaagctgctgaacgatgccggcactcgtattcattgattgaatccggtcaatggagatgtatctctttttcgtaaaaaacaagccttcttcaattctgaattctccgtcctcaatccggtatgtaaattttctccactcgatcacacttgccgtaatcagccagataagcaggacagcgagcgcaatgcctccgtaaaagcggatgaagtggttggaattaacaatatagacgagaaaaaatggcagaataatgtttttaatggtttcgataataatatggaataagttcaaaatcacggccgccgggtgcagacgtttcggttcagacatcatcttccgtcacccttgccagacgggaaatggaatccctcagccggtcagcttcctccatatcaagcgccggaatggaatgaacggttgccgccgtagagattttgactgaggccaggcggtaccttctgaggagcgggccttgtgaagtatctacgtgctgcaccctcaccatcggcacaatgacccgtttgactataaaaatgccggattgaatatcaatttcattttcatggacctcatagcgccagatcctgtgcctgattttcggtatggcatagacggatatcactgaaccgatgacccaaatgatgccgaggactccggtgatccaatacggccaatggaagaaatggcttaaaacagctgctgctataacggccagaagacagaaggcggacaggatgatttcctgaagacgccagacttttaagccgcttggactgattcgattttttggctgtgctctcaacatacctacctcccattttttatcatacatacaaatacggctgatttgcaaaaaagattcactttccggcatatcgaaaaaaagcggaccccgaaaaagggtccgcttcctgtgttttagtatgattttttctggcgtctgtcacctgaagaacggcggtcgcttgagcgttttttatcgtaggaagaacggttgttgtttttccctttgccgccgcggtagccgccgccttggccgtctctgcgcttagaagtacgctggtttttatagcgtttgctgaccatcggcgcttcatcagtgaggcgtacaggcgtgctgtccggctcttttgtcgccattttaatggctgcagccacaactgtcactgcatcatgatcttctaacaattccgcagctgccgtcatgtagaagttcaggttgttttcgctgatcgccgtgcgcagacggtcaaccgtcacctgctgctgaccttctaatgcttcgtcaagcgtcggctctttcatgcggtccattttgcgttttgtcgtttgttcgatcgcgcgaagcatgtttttctcacgcggtgtgataaacgtcatcgccatacccgtttttcctgcgcgtcccgttcttccgatacggtgaacgtaactttcaggatcttgaggcacgtcaaagttgtatacgtgggtaacacctgagatatcaagtccgcgggcagcaacgtcagtcgctacaagcacttcgatcgcaccttctttaaacttgcggagcgctaccatacgcttcgcctgcgttaagtcgccgtgaattccttcagccgcatatccgcgaaggttcagcgcttccgtcaattcgtcaacacggcgttttgtacggccgaatacaatcgcaagttccggagactgaatgtcaagaagacgagtcagcgtatcgaattttttgcgctcctgcacttccaagtagaactgctgaatgttggacacagtcatttctttcgcttttacttttacgtgttccggctcagtcatgaaacgctctgcgatccgtttgatcggcgcaggcattgttgctgagaataagagcgtttggtggtcgctcggcacgtttgagagaatggattcaatatcatcaatgaatcccatgttcagcatttcatcagcctcgtccatgacaaccgtgttcacgttgtttaaacggatcgtgcggcggttgatatggtcaagaagacgccccggcgtacctacaatgatatgcgggtttttcttcaatgcgcggatctgacgtccgatatcctgaccgccgtaaataggcagcactttcgcacgcttatcttgtccgattttatataactcttcagatacttgaatggctaattcacgggttggcgcgattacgattgcttgaatattaggagactcggggttcattttttcaacaaggggtataccgaacgcagctgttttacctgtacctgtttgcgcttgtccgatgacatctttatttaaaagtccgagcggaatcgtttgtgcctgaatcggtgttgcttcttcaaatcccatacgattgattgatttcatgagatcagaacttaattggaaatcttgaaacgttatagtcaaattattcaaactccttctgattgctgtttcagtaatgtcgtgatttaccactaaaaactgccctttcatccaaaggacaggatcatacgtatacaaagcccgaattactttacgtttaatcttaccattacactatgtgtttttcaataaggcgagatggtcaggcggccggaagcggcctgaccggattcttcccgcaaacgaggccggaccccgcgccggacgggatttcccagccggcggcctttctttttcatacggacagaattatttcaccctgaattagtttcttcatttttgtatatttttataatgctgatcagtattttttcagttcttctctaataaatctttaacgatttcttcgagcttcatacctctcgatgctttaaacagaaggagatcgccggaagcggccatatcctgtatggcgtgaagcagttcttttttgtcgagataatggctgacgcgcccttcttcaaaatgccggcgcgctccgtctgcgatgaatgcgccgagtgtgccgtaagtaaatacatggtcaatttccgccggattgatcgcagctccgcattcttcgtggaatgctttttcttcatcaccgagttcaagcatatcaccgagcacgagcattttcttccgatagcctttcatcgtttcgattaattcgaccgccgctttcattgacgtcgggctcgcattatacgcgtcgtttacgatcgagatgccgttttccgttttaaccagttccaatctcatccccgtcaccttcaggcggctcagtcccagagcggcattttccggcgtaatgccgaaatagatgccggcggcgtatgcggccatggcattcatcacattatgtctgccgagaaccggaataaagaaagaacgttcgatcccgtcgatattgaagtacgtgccttcttccgcctgttttatttctttcaggcggagatcattgacagcgcctgcgccgtatgtcgttgtccggcaagtgtacgccttttcgcggagcaacggctcatccccgaaataaaacagaacgccgtcttcccgaagtccgtttataatttcaagtttcgcctccgcaattccttctcttgagcctaaatcctgcatgtgggattcgccgatattggtaatgacggcagcttccggttcagcaagacggctcagaaaatcaatttcgcctctcgcgctcattcccatttctaaaacggcgatttctgtatcttcaggcatggcaagcacggtcagcggcaggccgatatggttgttgaaattgccggcggttttgtgaacacggtactgagtgctgagaacggcgtgaagcatgtctttcgttgtcgtttttccgttgctcccggtcaccccgatgacccgtgtgccgagttctttcaaataagctttcgccaatgtctgcagcgcctccagcgtgtcatcgacaaggatgacggcacgctcttccggcggattcggttcagagcggtcccacaacaccgcggaaacgcctttttcgaatgcttgcggcacaaaggtatggccgttaaaatgctcgccttttaaaggaatgaacagctgatttttttccaaagtccgcgtatcggttgcggcgccctcaatcattgtttgttcaaatacaggatttgtcagtgtgcctttgaccatgtcggcgattcgttttacagttcgctttatcaaaggtggcacctcgctttctgaaaatgttgtctgttacgggaaaagacactgccccttcaggcagtgtccgtcttcattaaaatgtatgtttaatcagctgtttttcggcatggcgttcttttgccagctcaaccagctgttcgatcagatcactgtaatctacgcctgcttctttccaaagcagcgggaacatgctgaatggcgtaaagcccggcattgtgttcacttcgttaatgagcacttgaccgtcattggtcaggaagaaatcggcgcggacaaggcctgatccgtcaatcgctttgaaggctttaatcgccatctcgctgatttccgcatattgttcatccgtcacttgcgcgggaatcattaaatccgtgtcgccgtcttcatatttcgctttgtaatcgtaaaagtcggttttcggcgtgatttcaccgacggcggaacatttcggttcgtcatttccgagtacgccgatttcgatttctctgccggcgattccttcttccaccacaattttccggtcatactcaaaagccagttcgaaggctttttcaagctcttcgcgatttcggcatttgctgattccgacgcttgacccgaggttcgccggtttgacgaagcacggatatcccagctcctcttcaacctgctgtaagcagctgtccggcgtctgtttccagtccttttttaagaaagcggcgtacttcgcctgcggaagccccgcttgagcgaacaaatgcttcatgatgactttatccatgccggctgatgatgcaagcactccgttgccgacataaggaacgttcagcaattccagcagtccctgaatggtgccgtcttcaccgttcggtccgtgcagaagcggaaatacgacatcgatctgcgccttttcgtcaggcgacgcttcaggaaacatttcccggttcaatgctgatagagcgaaactttcaccgttttgttccagctgaagcattttcacgttggaaaccggctcagtcagcagcgggcctctttgccattctcctttttcagtgatgtaaatcggatgtatatcaaacttctcagtattaagcgcttttgttacagctaatgctgtctgcagcgatacattgtgttcggctgactttccgccgtacaccaatcctagacttgttttcaatggatattcccccacaacaattcatctttactatcttatcactttcctcagaaaatgatctaattatttttgggcattctgaatatgaaagcatttgtatgtaattcctttttattttatattaaaatggcatggaaaaggagatgtgtcatatgaaaaaaatcagtacaacagaacaatttaatgaacttattcaatccgacaaggaaatcatcgtgaaatttttcgctgattggtgccctgactgcacgcgcatgaatatgttcatcggcgatattttggaagaatataatcaaaatgattggtatgagctgaacagagacgagctccctgagcttgccgacaaatatcaggtaatgggcataccgagccttctgatctttaaaaacggcgaaaagaaagcgcatcttcacagcgcaaacgcgaaaacgcccgaagaagtcacagagtttttatcacagcatatttaattcgtttcacgatctttgtttatgacttcaggctctacatgaacatggacatgagtcacatcatgttcatgttttattgcatattcgacttcatcggctacttcatggccttctttcacagacagtcccggatctaccgtaatgaccatttccacatgaaccgtgctccccaaataccttgctttcacatccttcagcctgctgacctcttttatttctttcactgtgtgtttatacggctccaaatctttcagatcaaacccgtccgttaatgagtgggaagcatctttgaagatgtcccatgccgtcttacagatgataattccgatcagaaaagcaatgaccggatcaatccacggcagatgaagccgggccgttaagacgcctatcaacgccccaatactgacataggcgtcagaacggctgtctttcgccgccgcatgaagcgcagaacttttaacccgatccgcaagacggctgttatatacatacatgccgtacatgacaatcgcgcttcctagcgccgtccatgccgcaatgaagctcggctcggcctccgttccgctgacaatcgcctttgctcctccgatcagcacttcaataccgaccgccatcataataaaagacgcaattaatgaagaaattgtttcagcccgataatgtccgtaggcatgatcactgtccgcggggcgctgggaaatccggagcccgatcagcacagccagtgatgcgacaatatccgtagcattatttaacccgtccgcactgagcgcttcggaatgataaataagaccgatcaccagtttgacggcggcaaggataaggtacgcggcgatattaagaatcgcgcctttttcgccccgttttaagtttgccgtttgatcattcatgtaaggactcctccattctcattcatagtatggatggaaaagcggaaaaatagcagctttgatctgaccaaatgcaatattcgacagcattattccccgggaaactatttgtcgaaaaattggcggtatttttcctttacatatgaatatgtccattgtataatttcattaactgataatgattctcaatatcaattgattaggagggtaatcatgaggtcttctcctcagctcagatcatcagttgaaggacgaaaaaaacatctgatccatttgctgatcaataacggaatatacaaaaagtcggaacggcatttatatgaattatcgctcggagaattagaaagcgaatacaaatatgtaaggaaggtgcgggctcatggcgaaacgtaaaataaaaacatacgaacagctgataaaagaaaacaaggcggccattatgaataatcaaaagctgatgaatgtgatctatgacagaattgaccgcaagcatcaaaaactgctccggcacaacagccatacataaaaagagcctttttcaggctcttttttttattgctcaaaggcttccgccgctaatttgccgatgaccgcatcgtccatcggcggattgtgaaggccggcccgggcatcccgataataccgctgaagcggattatttcgctccaggctttttgcgccggtgattctcattgctttgtcaacaacagaaaggacggcatttgtcacaatatgttttgccgcgccgagctcgcttttgatgaaagggcggcgtttcggatcatcatacatttgcgccgccgtgaagagaaactgtctcgcttttaacaattcaagctccatttccccgacacgctgctgaacggccggcacgtctttaatcggtccgttcaggctgttcggcgaatattcagatgcaaaccggacggcatagtcccttgccgcttgagcgatgcccagataagcagcgggaatgtgaagcagccagccattcactttcgccgctctcggcccgctgataagctccacaagccgctcgtcactgaccgtgacatgatctaaaaggagatcatggcttccggtcgccttcatggcaatcatatcccatgtttcttcgactgaaacgcctgcctgatctttatgaatgagaaaaacaccggtcgtttgtttttcttcaatccatgccgtcacaagcatataatccaaagtcagtgaaagggttgtaaaggtttttcggccgttcagcacccattttccgtcttttttgacagcggaagtgccgggtcttcctcccctcgtcggactgccggtctgccgttccgtcgctgccctgttcaggacggctccctttttcacctcttttgtgataaatgaaaagacaccttcatcccagctgtttccttctccgagctcacccatgacggataaatgccagccgattccgagagcgacggccgcgtctccccgcgccagccgttcctgaaacagcaccatctcataaacggaaatgcctgcaccgccgaatgcctcaggtaccgttaacgccgtatatcccgcgtcgcgcagtctttgaattttctccgcgggaaaacggcccgcctcatcatcaagcgcggctgttttttgaaattcgtctgcaagcaggccgattttttccatccattcccgctgccgttcattctgtatccataaagacactggaatccccccattataattccgataaagttaataagtattatagagattcaagtctcgtttcgcaactgtgaggctgtacaaaaaaacgcgctattccatagaatagcgcgttcagactgcttccgggccgcggtcctgcttgagcccgagataaatcagcatatatgtgagataacccatcgtcatcacaagcccgccaaagaaaaagcttgaaaaaatcggctcttcaaacgcggtaaccgccgcaagcacgatccagcttgcatacaggtagatgatgaaataacggaatcccgtcttcattttatataagagaaacagccccactgtagaaaacaaacccagcgcaagcctgaaataaacaagatgttcgaattgaaacatgaatgacacaaaggaaaaaccaagcaataacacaatcggtaatgcggtaataaaatttctcaagtgagcacctccgtcattacctttattataaatcaaaatagcataaattattgatttatcgtgatctttttcacaaaaatgtcattcctttactttatacccgaatatcgcgtttgcaaaagctccaccaagcgacggctaagaagaatacgatatggataatgataatgcctgcggaaaataacggcgtcattcccgcaaacagcggcttcgccccgctcatatattgcgtcaggtcagtatttgcgaacagcagaaaactaccccatttgttttggaagagcgacataatcgtcacaagtgattttgcgccgtacagcacgataaatgacaaaatgacggccgttgcgctgtttcggaatacagaagaacacaacaagccaaagcatgccatcgcaaacgcctcgacccagttcgtgccgattactttcagggtgttcacaagaagcgtccctgattcagatgtcaccgacactccgaagaaagccatgccgaacagcagagacagaatatagtacgccgcatacaggtacaagctgaccaaaaatacggtaatgagtttagatacaaaaatccgctcccgctttaccgggcggattaacaaaaatttgatcgttttcttatcaaattcagcggaaatgatcgttgccgcgatcacgatcgttaatgcctcaagcagaatattcagcccgggggcgtacgccatatagccgatgaaattctcatccgttccggaactgatgacaagccgtttaatgacaagcgccataataaattggagaacggccatcagaatcagcgccactaatgagacttttcggttaaagagtttcatatgctcattcgctgtcaatttaaacattcgtcttcccctcctcttgaagcgccgtcgtcactttcatgaattcatcctccagcgattccgcatacggcatgatggaatacacgagaaagtcttgtccgacgagcgcacggtttaatgccgggatgtccttcttcgctacggtgacggtaatgctcccgccgtttttctccggaacgaattgctgctgggacagccattcgaaggcttcgtcagccggctgaatgtcgaggatggctttttcttctttttccgcagcgccgcgcagaacaacctctgttttgatctcacctttttgaatgatgatgacacggtcgcaaaggtcctccacttcacgcaataaatgcgtcgcaaaaaggatgctcgtcccttcaagctccgcgagttcctttaagtgatcgcggaaatccttcattccgccgggatcaagcccgtttgtcggttcatctaaaatgagcagattcggacggtgaagaatggcctgtgcaatcccgagacgctgacgcatgccaagggaatacgttttaactttgtcatgaacggcatttgtgagcccgacccgctcgatgacttcctgaagcctgtcttctgtgatgtttttgtgcatgttggcaaagtgcttcagattttcccaccccgtcaggtacgggtagaattcaggattttccacgatcgctccgacggattcaagcgctttttcgaaatcagcatcgtgctgaaagccgttaattgtaatcgtgccgctgtttttctttaaaaggccgacgatgattcggataagtgtggtttttcccgacccgttcggaccgagcaaaccgatgatctcgccctgcctgacatccatgctgatgttttttaaaatgtgctttttgcctattgttttgtcaaggccttcaatatgtaaaatcggctcagtcatacagccttcctcctttttcacaaaaaataaacagtgcccgtacataggcactgtctgcattataacattagtcatatattcgtgaagagccggagccgtcgttatgtcttatccgggaccggtccgtttttttccttctcctcattattgacgacatccagaatatcaagcaggaacacaaaaatcggaattccgataatcaagccccaaatgccgaagaaatgttctgagaaaatcagaaccgtaaaggtaaaaaagatcggcagttccgtttttgctgacatcagtttcggattaaggaagtacgtctcaatcgcatgaatgacgaaaatgaccagcacgatgtagatgacgtacgcagcgccgcccgtcgtatacgcgatgatgctgagcggaatgagcgaaatcaccacacccgccacgggaatgagcccgaggaaaaagaccatgatggacaggccgaacagctgcggaaaatgcagaatcgccaatgcgatcaaggtgaggatacagttcaccagcgcgataataaattgggcttcaagcactttgccgaatgttctcgcaaatttgctgccgaaataagcaagttcgtagtaaaaaacagacagcttgctgtgctgaaattttttcataaactccgtgagccgctttttctcgaacaggaaaaacatgctgagaatcagtgacatcacgacctgcaaaccgaaagtgctgatatcggccaagtatgtatacagtacattaaaaccttcttttacataggaaccgatattgatatcgccgaacacgctcgatatctcatcataaaacggaatgacatcgggatgatacgcgatgtgcttgatctgcttaatcagctgttcaatctgcttggcaacaatcgggtaaaagacaaagcctccgacagtcgccccgacagccagcgcaatatataaaatggtgatgaccaccctctggctgatccggaaaaaatggttcaacacgtgccggatgacagtctccagccgatccatcagaaaagtaaaaataaacgtaagcaaaatcaaattaatcatacttcggaatacaactaacaccccagtcaaaacaagaaaaacggaaaaacgtctgacacccggatgctgaaaaaatttaaaaatagccgccatttatacactcctgctaggacaaaaagcccttagatttcatctttcactctctaattgtaaattatataacaaaatgacgctaaggtctttgtccacctcctaataaatttaaacaaatttatcttttttactcatggcggccgaaaaaaagaacggcatgccggatgcatgccgttcctttccttttataccgccgtttttatttcttttacggcctgtgtgcttttcgcttcgtcaaactcattttcgctcttggctacgatgatggtggcgattccgtttccgatcaggttgacgatcgcccttccttcactcataaagcggtcaacgccgaggagcagcgccagtccctccagcggaataacctgaagcgccgataaagtggaggcgagcacgataaatccgcttccggttacacccgccgcgccttttgatgtcagcatcagcacgagaatgatcgtaacctgctggccgatggtaagatcaacgccgaacacctgcgccagaaaaaccgtcgccatggacagatagatcgaggtgccgtccaggttaaaagaatatcccgtcggaatgacaaggccgacaaccgatttggaacagccgtaacgttccattttatccatcatccgcggaaggacggactcagaagagcttgtgccgagaacgatgagcagttcatctttaataaaacggagatagttccacaagctgaaaccgaatagtttgcaaatgatattcaaagcgacaaatacaaacaggaacatcgtaacgtatacagacagcatcagactcgccagcggcttgatggaatcaaggccgaagtgcccgatcgtataggccatggccccgaatgcgccgatcggcgccgcgcgcatgatgtagccgatgattttgaaaaaaacgtgcgacagtttatcaaagaaatcaataatgcttttgcctctttcaccgagcgccgccaggccgacaccgaataaaacagaaaagaataagacctgaagaatgtcgccttttgcgaaagcgtcaaccatatttgacggaacgatgtgagtgataaattcaatccagtcaatcccctgtcccccgttttgggtgtactgagagacatcccctttttcaagcttgctgtaatcaaggccctcaccgggtttcatgatattgacgaccagaagcccgataataagggcgatggtggtcacgacttcaaaataaataaatgcttttcccccgactttgccgacttttttcatgtctcccatcttggcgatgccaagcacgatcgtcaggaatatgatcggtgcgataatcatttttaccgcattgataaatgtatcgccgagcggcttcatctgcttcccggcctcaggccaaacgagtccgacaatgacgccgatgatcaccgccgtgatgacctgcaccgtaagatttttgaaaattttcatccctactcccccttgcctctcgatgcgtctatacaaagatgatagcgttttcatacgaagaggggaagcttatgatcataacggacattttggtctttttggtctcggctagcggacgaatttgtagcggttaaccggccgtcccactcccccgtattgaatgtcgagcttaatctggccgtccttctcaagaaaatcaagataacgccgcgccgtcacccttgcgattccgagcgctttggcggcttcttcagctgaaagcggctccgtctgctgtttcatataggtcaaaatttcattcatcgtaaaatggtttaaccccttcggcagatcccgggacggattttgcggaattttcagcagcatgtcaagctgctcttgcgacatcgtgtcatgctcttcaattttccgtttatattgtttatagttttcgagcgcctgtctcatccgctccagcttaaacggcttcaaaatatagtcggccgcaccgttttgcagcataagctggattgtttctttgtcttttgcggccgagacgatgatgacgtccacttcgagcttttgttttctgatttcctggagcgttttaattccgtcttttttcggcatgtatacgtctaataccacgagcccgggccgcagatcttttataagcctgattccctcgtctccgtcagcggccgtggcgatgacgctgaaccctgaaacaccggtgataaattctttattcacctcctgcaccatcggatcatcttcaataagcagcaccttgatgtccatcgaatgattcctcccccttcatcggaaataatatagaaaatgccgttccctgtccctgccgtgtgtcgacttcaatcacgcccatccctttgtcgacgatttgtttgacgaggtacaagccgtatcccgttcctcccgttttattgacggtaaaccctttgtcataaaggcgcgggatatgctgatcggaaatcccgcttccgttgtcttctattaatatagcaagcacttcatcattttgctcgatactgatgtcaatatgtttgtcctccgtgtccgctgtttcgaatgcgccgaacgcattttcaattaaattgccgagcaggacgacgatgtcatgctggtcgacatgctccggaaatgccgagaaactgctgttttcatcaattttcacagaaatgccaagctcttttcctcttttgattttgcttaacagcagccccgccgcggcgtcattctgaatggcctgatgaagaaaatcagtgacgctttcttgttctgatgattccttaaaagcaagccggagcgctttttctgattttccgagctgaatcagccccgcgatggtgtgaagcttgttcatatgttcatgattttggactctgagcgcatcgacaaaatttttcacacctgtcagttcttccgccattttcgccgcttccgtcctgtcctgaaaaatggcgacggctccgatgaccttctttttcatgacaatcggaattctgctgctcatgatcacctttccgctgacttggatttcttcattatatacggctcggttccgctcgacgatttcagggagccgcgaatcttttaacacgtcccagatcagcctgccgtcggtctcttgtctgacattgaatatctgcttcgctttttcattaaaaatggtgatgtgatgctgattatcgatcgcaatgacgccctcattcatcgagtgaaacgtagcggtccgttcctcatacattctcacgatctcatggggctcgagccaaaacatttgttttttgatgtggcgggccagcaaaaaggagccggccagtccgaacccgagcgccagcagaacgataaacagtatttcatgtttcagctgaagaagaatttcaccgaatccgggcagcgttttaccggcaaggacgacgccgatctgattcaaatcccggtctttgatgggataaaaagcgcggacggcggtgccgatctctccctttgcttcggaaaaataaatgtgctcggcgaacgccgcggcttcgtcctcaccccttgaacgctttccgatcattgtgctgacgggatgtgaatagcggatatgatccatatccatgacgacgatgtagtccgcttcattgatgatccttatttcttcgaccgcatggcgcacgtcttccctttgttttttctgctccagggcgcgtttgacatcggtcatctcagataccgtccgcgcggtattcatcagccgttttttcagctcgcgctcctctgtatgctggatattgccgaccagcacgatgccgacgatcaaaaaggtaaaaagcacgacgatataagaaagtatggtgattttccagcggatggtaagcttttttttcgtcattggcctcttcctttccgtctctttacgaaaacggcccgcccgattatgcttgttatagaaaatggcggagggggttttcgatgaaaagcttgctgacttgtctcagcctgatggtactcggtatcggaaccgctttattcatcggctttcatgatcgtttctcaacagaagaaccgtattatgatgacgaacaggaaggcctgaaagatcaaatggttttcaaattcagtcatgtcgtggctgaaaacacacctaaagggcgggcggcgaataaatttgccgacctggtctatcaaaagtccggcggtaccattaaagtagaggtatttccaaacgggagcctctattcagataatgaagaaataaacgccctccaaaacggggacgtgcaattcatcgctccctccacctcaaagctcggatcactgtctcccgaatggggtgttttggatctgccgtacgcgtttacaaactataaagccgtgcaagaaggcctcaacggcaaaatcggcacgcgcctgttcgcttctttagaaaagcatcatttgaaaggactggcgtactggacgaacgggtttaagcagctcacgtcaaataaagggccgatcttctctccggacgatttgaaaggacaggcgctcaggatcatgccgagcagcgtgatcgaagaccagtaccgcctgctcagcgcgcacccgcggcaggattcctttaattccacgtttcagctcttggaaagcaatctcgtagacggagaggaaaatacgatttcaaatatctattctaaaaaattttataatgttcaagattatttgacaatcagcaatcacgggtacctcggttatgccgtgatgaccgacgagcatttctggaattcacagacagaaaaaacgagaaccatcttaacggaggcgatgagagaaacgacggaatggaacgaagcctccgctgagaaaatgaataaagaccagcttgaagagataaagaagaattcatccattcatattcatgtgctgagcaaagcggaaaagaacacatggatgaaacgcctcgacccgatttacggacaatatgaacaggtgatcggccgcgggcttgtgcaggatttgttatccttgcgccgcgagccttagcaggaccaatacgcccatctccgtttcatcccttttcccgccggggaagtaaatagggacagagcaaaaaaggagatggagacatgtttacacatacgaaaaaactgcagcatccggctaaaccggatcgtcctgacccgctgttcgcaaaaaagatgcaggaaattttagggggacaatacggggaaatatccgtcgccatgcaatatttgttccaaggatggaatacacgaggcaatgaaaaatataaggatcttctgatggataccgcgacggaagaaatcggccatgtcgaaatgatcgcgacgatgattgcgagactgttagaagacgccccgctggcagagcaggaaaaagcggctgatgatccggtcatcgggtccattttaggcgggatgaacccgcatcatgccattgtctcaggactcggcgcaatgccggagagcagcacgggcgttccgtggagcgcaggctatatcgtcgcaagcggaaaccttctggcagacttccgcgccaatctgaacgccgaatcacaaggaaggcttcaagtcgcacgcctgtatgaaatgaccgatgataaaggcgtgaaagatatgctcagctttttattggcccgcgataccatgcatcaaaaccaatggcttgcggccattaaagaattagaagaacaggaaggtccgatcgttccttccacattcccgaaggcgctggaaaaacagtcattctcccataagcttattcatttctcagatggagcagaaagcgctgaacaaaattggctgaaggaaacagcgccggacggagaaccatttgaatacgaaaaggaaccgaaagcgcacggcgaaatagctaagctggaccccgtcccgccgtatgtccacaacacgcttcccggacgaaaataaaaaagcctctaaaggggctttttttatgtgcgcacaactgtccagtccggttcgtaccggatgtcggggtgatgtaacagctcgtgaatgacaggttcatccccctcgtacagcatcacttctattgaaagaatcgcagccttctgctcgttttcttcgtatatgcggtcatgttcgttctccataaaatcatcataggcctgtctgtcctcccaaacgctgatgatctctgcgatgaacaggccgtctgcgtttttccgccagccgcctgcctgtctgacgaagccatttacacatgataatgctccccaccttgactgtgcttgcgcaaatgcttcagcgtttgcagcgtctgtttcacatacaatctttttgatcagcatgaccgttcctctgtgatgactgttttcgcatgcgtatgctcgacacagagattcacggttctgacgtaagagcgggtgcggtgaatcgtgcctttcgggatgagcaggctgtcatttgctttgagcactgcggtttctttgtccttaaaatcgatcagcagctcaccttccagaacgatgaaccattcatctgagtcagggtgatggtgccagtcatattctcccgtaaacactgcgaggcgcacacagtggtcattgatctccgcgattgaaaaattgtcgtgtttttctttgactttatggcgatagcgagcaaattcagcatgtcagacacgagtgaaaaacccctttttcattttattgtatcggttttgcggctcagatcaagattttcccaaaatcaaaagcgatccggctgatgtgccggatcgcttttgatctgcaggttgtctgccttttatgcttttattagctgcttcgtctgtttccgcctttttggccgatttctttataaaactctttgtcatgatttttacttgtagcttctccgcctttttggccgatttcctgatagaattccttgtcatggttattgcttgtggcttctccgcctttttcaccgatttcctgatagaattctttgtcgtgatttttgcttgtggcttctccgcctttttcaccgatttcctgatagaattctttgtcgtgatttttgcttgtggcttctccgcctttttgaccaatttcctgatagaattctttgtcatggttattgcttgtagcttctccgccttttttacctgcttcttctctgctcattttgttattatcttgtgccatttttgaattcctcctttaattggtgttggttgttggtttcccgatttcagaactgataaacaaagaaaacacattgaatgtgttttcgggtggttttttatcattctgtatcgttcatgcgttttagaatccggcgttttttataaagcatgatgcctgtttccgcgatgctttctaaagctgaacggttggcggacgcgccgaagatgatgcctgcggccggaaccatttgcagcagttttttcgcggcgaacgtatcgcggtagctgtaaacgacttcccgccagccttggatttgcgaggcgacgcgctgataggtttggtcgttttgatcatattgccgtaaatcttgcaggatcgctttttttccgatgacgtcactggatgcaagctgaagcaatttgacgataaacacgcgttcttttttgtctttcggatcaaagccgtaagcaaccgcgatatcttgcagcgtctttaaggacaggccgagcatcgccggaatgtctgccgcaagcgtaaacacgccgccgactcccgttgcggctccctgcaccgtcgcggcctttacgcttgtacgcgctatggcttctgcgatttcgtccatgacggcaagcggcgcattgcggatgtcgtgaagcgtttgacatgtaccgtgcggcagccgtttttgaaactttttcatgatgcgcttttctgatgtaaggtactgtccgcctgactgaataaacgttcccgtttcatcgagaatgagtccgattttcctctgaataaattgcggtgtcagcttgtccaaaagctgaaacggcaagcgggtgaatgtttgccagaacatcgccctctgctgcgccttttcccatttttgaatgtctctcagttgtctttccaggtctgtccgctcttctgtcacccgtcctgcacgtcctttctgatttctttctacatagtatacctttatggcgttttctttttacacccggccggactttttatccggaaaacattccattgattaattttcttcaaattctatatattttataattttgaataatacgattgaaggagaatgctgtatgcaatggatttatttaagtttagcgatcatttttgaagtattgggtacgatcagcatgaaattatcaaatggatttacaaaacttgttccaagtattttattgttattgttttatatcggcagcctttgttttcttactttgactttgaaatatataagtgtctccatcgcgtatgcggtctggtcgggaatggggatcgtactgatttccgcgatcggaatttttttctttcatgaacagttctctgttataaaagctgtctctgttcttctgatcatcatcggtgtcgtttccttaaactttatttccgaaagtgaaacgtcatcaaacggcatcagcgttcatacggacagaaacaggtgatgaaagggttaaaggttctcttcctcattacagatattggatttatcatttattggattgttactttttttgagtagattccaaaaaacatggcgtttaaagattatgataacgccatgataatggcctggaactggtcattctttcccctagatattttcatttcattgaccgggctgtacagcttgtttctttataaacggaaacattcgttatggcgccatttcgcattaatatcacttgtgctgaccttttgttcaggcctgcaagcgattgccttttgggtatttatcggtgattttgatctcatgtggtgggcattcaatctgtacttgcttctttatcctttatattttattcggaaattgctggtctctcgtaaaaatagctgtcattctttttgatgaggcggttttctttttcttcaggcgggaaacacttttcataaaggagtgatagacatgccttggtctatgaaggattatccgcaatcattgaagaatctcgaggaacctgtgaagaaaaaagcgatcgaaatcgcgaatgcgatggtagatgagggttatgaagaaggacgggctattcccattgcgacaagtcaggcgaaagagtggaaaaaaaacgcttctaaagaagaaatcgatcagctgatgaaacacgatgatgaaacgaaacgcggaaattgaatcggaatatagaaaaaccccgctctcaagagaacgaggtttttctgcttataaaccgtaataataagatagtgtggtgactgaaacgtagcctgtcgctcctgcatacgtgactttcagccatttattggaattggtgtagtggccttgaacatattctccggtgacccaagaacctgtaatttttttaccgcttgagaatgttgtgatcgttgaacagctgaccttagagcatgagcgcatattagcaccgtaaataccgactgtgcccccgctggctaaaatggaaacgtccggttcagctttaggtttgaaagctgctgctgatgcagagccgccaaaagcgaataaagaaacagcaaaaatcatggctaaagaaatgatcgacaaacgacgtaccaagaaaattccccctcttttatcatatggccggaaagctttcctgacgttattatacttttttgcccggaagactgaaataagtctaatgctccaacttcttttcttcgcaagtgaccatgccgattctttttttgatagataacagccgtttattggactggaatcactgatatatcgttgattcaaacgtttattcagagcggccggagtttttccggaggtcatttgaatggtacagaaaggttttatcttccaatggaaagaaacattattattctatttacccgggaaacggaggaaatactgcgtctttttctcaggatcagttgcaccggacagaaagttgtgaagtgatatgagcaagtgttctcttttcacctttttaaaagaacgctcaacgcatccgcgcatgatcggacgcggaaacatgctttgcgaacggcatcgcttctttcccggaacgatgccgttttcattttcggacctttcttcggcgggatacatatcatagataaaacagggcatcaatgtaccggtttattgaacataaagaacttgacatctcataaaagcggatttatgatgtagataaaataatttgcatctaggaaactttttgttatttagctaaaaatctatcggaatttaggtgagacataatgagcaaagacatctcagcacaatcactgcaagcaaaagccgtgcaggatgcacttgacggcaaaagcaagggattcaagcggcttctgcctttcttaggcccagcctttatcgcggcgattgcctacattgatccgggaaacttcgctacgaatatctcagctggttcgaaatttgggtatatgctgctgtgggtcatcctcttttcaaacttgatggcttttttaatccaagttctttccgcgaagctcggcattgccacgggtaaaaaccttccggaaatcgccagagaccggtatccgaaatgggtatccgccgggctgtggatacagggtgaactggtgattatggcaactgacctggcagaatttatcggggcggcgctcgggctcaacctgctgttcggcataccgatggttgaagcggccattatcgcggcgatcggatcattcgcgattttagagctgcagcgccggggttaccgggcgctggaagcgggcatcgccggacttctgtttgtcgtggtgatcgccttcgctctgcagaccttctttgccaaacctgacgccggctctgttctcgaagggctgtttatcccgaaaattgacggaatggacagtgtgctcttggcaaccgggatactcggcgcaaccgtgatgccgcatgccatttacttacattccgcactgacacagcgccgtgtcgtcggaaaaacggataatgagcggaaaaagatttttagattcgagacgattgacattctcatcgcgatggtgatcgccggggcgattaacgcaagcatgctcatcgtcgccgccgcgcttttcttcaagaacgggctgtatgtagaagatttagacgtggcttatcagcaattcggccactatatcggaccggcttcagccattctcttcgggatcgggctgctggccgcagggctttcaagctcttctgtcggcacattgtcaggcgatattatcatgcagggcttcatccgttaccgtatcccgctttatttgcggcgtttcattaccatcattccgccgatgatcatcattatctcgggggtcaacgccacagaagcgctcgtatggagccaggtcgttctttcattcggcatctcctttgcgctcgtgccgctgattatgtttacaagcaacaaacgcctgatgggcgccctgacgaaccgaaaatgggtgacggctctcgcctggctgattgcggttttggtgatcgcgcttaatctgtttgtgatctacgattcattccgttagaaaaaaaccggccgtagcggccggtttttcttttgacgccggatgccgttcgtatctttttccgggcgtttttggtatgatagaagaaaaatcggagttttgcttatgtcagtatttatccttttttatctgtggattgtgccgattgtcatcggtatcttctgttctctttttgcttatcggacaacgggtaagaaacgtctgattcccggctttgtgatgatcgcattaagtatcgtttccttaatcacggggctttggatcggcggggtgaactatcatgtgttcatcggaggcatgtttttattcggtacgtttttggccggttccgccttcccgtttttcttcgctctctcacgcaaacgaaaataaacaggcatgccgcctgtttattttttttacctaagcctgcattataaaaaccgctccgataatgtgattccgcctcaatcagcctatacatgcaggctccagcccatgttcatttcacgaaactgcagctaaaataaatcctgccaaaaaaaaattttgaattgcgagaaaaatatcgtattaaaatcctatttacccaaaaaatacctattgatagaatggtatctgagagggaaaaatgttcaaagcggatcatacaggtcccgcctaaatacatagtctttcatttctctctacactacatttctaaaggaggatttcccattagacacgcagctaaaggcattctgtttgccgcatctttagcccttgtaactactgcttttgtccccgcatccttagctaaagaaaatcatcataatactgccaatgccactggaacgacaaaatcatttttttatcagactgatacgcaattttcctacggacttaaagcacaaagcgatgcatctgtgtcaaaaccagtcaaagatgtaatcagagaagtgctgaaaaataaaacaaaattattcaatcttgttgaaaaattagcaggaaagaaaataagaaatgaactcgaatccgttttcaatgaacacatcgaaccggttttaaagaaaatgctgaacgagtatgtcgccttaagctggactgacgtggaaaagaatctttatctttcacttaaaaagtccggactttctgacagccaggctaaaaacctcgctcatttgacaactttagcaatgaaagcattttaaaatcattcataaatgatcgtcaggaaaatacgtataaagtaatgcaaagtgctgttagattcactctaatagcactttttcattggagatgtcacatgactgtcttttttactgttttgctcactttcttatgctgccttgtgatttcatctcttatttttatgattctattaaaaaaagagatcgtggatacaccgccaaaccgcttagctcatgcagcattcatcatacttattggattctccctgttcttcgctgtgactgtccccagcctgattatttgttttgcagctgtaacaatacatcattttttcggagagtatatcatctatggttcactttcagacttatacatattttctgtcgtcgtcagtatcttagctttagtttatatgctaatccttacggcaattgtaaaaggaatgactcatgtttttacattacctgcttggtcagcctatatccttgaattcatttttgcatgggctgctgtttacttctcaatccaatacgtttccaatcatatcattgagaacatatctatatttcaaggtggagaaattcttctttcattgttcatcactttcttattttcgggattggatatcctttttactaatttggataagatcacaaaagagaaattaggctaagggggtaacaaatatgaggatcatgacatatatatcttatttttctatttctttagttttgcaggtggtatggctgctattaataaaagatactcctaatatatttctgatagatatgattacggtgtccttcttattcactctctttatgttcatcttggatcaaatgttcaaaaaaaagcggacaaattagggtctgtttttaataatcctcgggcttctctttcgttttgaaattgttccggatctggggatgttgcggcgaaccgttcattaatgtttaacaccagcctcggtaaaatacttctccttttatataacatcctgacttttccgtcatatattcaaacgaaaaaacggcaaaaaggagtaatgaaacatgatattgtttattggcaagttcatgttgctctttttattctgttcgctggcatattatttgtttaaagttgtttattacaatatagggaagaacattgcgcttaaaactccgaaagggacaaagacgaaccggacggcacatgtgtttgtcaaaaatggaactaaactgaatgatggagattactttatgatcgctgttgtgaccgctctctggctgttcttcagatgaaaccgcgctgatccatcacgagttttttgatcagccatcgctcgccagctgccgattttcacaatcatcgttttcgtttaggacgactatatgcaagcaagccgctcaacaaacaaaggagctgtcgagatcttctcgatagctcttttgtttgtccttgaatgattgaagataggcttaaaaatggacggcgtctttctcatgcatgcatcgttcaagaaaacacttcacagcaaaacggaaaggtgaacgcaatacaagtaacggttaagaaccttatgaggcagcgtatgttgattactggataagaaaaagaaatcccccagtcttaaaaggtggaggtcaaaaattggagaacacttaaatatttatagctttttcagcgatataaaaagttccagagtcactcatttcagcagtataaacatttgtcacacttaataatccagtaaaaagaataccgattaaagcggagctgattataagtttcttcattatatagcctccgtaaccttaagtatttgtgtttgggcatgtatggttttctttaaaaagtttcttccctctgcatagtttctcttctcaaaatgaaagtcacctaatttttcggttagctctgcgaaatcagaccaaaggcgtttctcttccaagtaacctaagctttgtttcacttctgtttcattatattcttcgtacaatgaattaatgatttttaatttagccaaatattcctcttcattagaagtccgagcacgatttaaagccgtttcataaaagaaacgtgcttccttggctttatcacattggtacaggacattcgccatcatatataatgatctcactccatacactgtatcaatatgttctttcacgtctattgcctttttgaaattctcttcagcagcaatcaaatttttccctcttaaataaactaagcctgagttatgaaagatcactccgataattcttttcactttttcctcatccaagccacgggcgttacttaatgcttcccgataatatgattctgcctccgtcagcctgtacatatcgtacatgttagcaccgaccatcatattacagccaatcactttcactttgtataattgatttttttcaaacaattgcttggctttttttaaatgattgagggaaacaaagtgctgatcaatttgataataggcatcagctattttgtaatgaaattcagcttgctccatttcatctgatacagcattcaactctctctctgctttgcgataatagcttatcgcatcaacatactctttatgatcaaattcatacattccacgaaaaaataatgagtaatacttcaagaggcctgtaagtcttttttgcggcttttctattttttcaagtagttcgtcgactgtggggcgatctcgatatctgtcttccggctccaaggaatctaacatcaattggtgacgaaagcacatcaatgaataaaaaacaagcaaatcctgatcctcttccatctcctctatttcctgttcgacctcagcctttaaaatctcagcatcaggcacactgaactggcgaatcattttgtaccattcattgatcttgacaccaacttgggacgacggtaaaacttgatccatatatacctctccctctaattgctatttttgtaatattataactatttgaacataaagtgaaaacgaaaaaaaaccgcaatttacttttgcgtcatactcacctgattaacttgttttaagacacagggaaattatacctcaacataaaaatactgtataaaaatactatttacccaaaaaatacctattgatagaatggtttctgaaggaggtggaaaaatattcaaagagaataatataggactatcctaaatacatagtctttcatttcgctggcagattacattcctaaaggaggatttttcattaaacacgtagctaacggtattctattcgccacatctttagcccttgtaactgcttcttttgtccccacatcctgagctgaagaaaaccgagataccactactaatgccactggaattaccaaaccaattttttataataattgataagccgttttccttttagcttaaactggttttaaagaagctattaaacgaatatgttgccttgagttgtattgacgtggagagaatctttatctttcacttaaaaagtctggactttctgacaaggctaaaagcctcgctcattggacaacgttagcgatgaaacattttattgttattcataaattattaggaggaaaatatatatgaagaagaaagtaatccctgtagttttaagcgcaactctacttacatcattcttgggtacttcaggtgctttagcagctgaaaacagaaccacaactcctgtaccggtaacgaaaactgcaccaggtactattccaactggaatgcctggcactattccaaccaaagcggctctcaatggtgactaccaaacccaaggtgtagtttcgtggtcctataaggctttcagagctgcctgccgttcaggtggatggcttttatcaaaagccttaaagccattctcccctaaagctgcggcatggattagaaaaaactctaagaaggttgccgacattatggataaaggtgaaaattggggtgtaaaacaatttacaaaagcttttaaagctatcggagctcctacagatgtagctaccactttagctaaattcattgttgctttgatttaacatatttaaaatttaaagtgctgttagattcactctaatagcactttttcattggaggttaacatggctatctttattaccgtattgctcaccatactatgctgtcttgttatttcatctcttatttttatgattctattaaaaaaggagattgtggatacaccacccaaccacttagctcatatagcattcatagggcttattggattctccctgttcttcgctataactgtacctagcctaggtatttattttgtagctataactgtaaatcattttttcggagagtatatcatctatggttcactttcagacttatacatattttctgttgtcgtaagtattttagctttaatttatatgctaatccttatggcaattgtaaaaggaattactcatatttttaaattacctgcttggttagcctatatacttgaattcatttttgcatgggctgctgtttacttctcaattaaatatgtttccagtaatttcattgaaaacatatctatatttcaaggtggagaaattcttctttcattcttcataactttcttattttcgggcctggatatactttttactaatttggataagatctcaaaagagaaattaggctaataaaaagaaaagcaggcaatttagagcctgcttttttattccctttttaacatttctccaagccttgctttcgttttcggcccgtaaatgccgtcagcaggcagtccatacatggactggaaccgtttgactgcatttgctgtcttcggtccgtaatagccatctattccgttgttctttgcccctttgtccggataataatagagagccgccaaagctgtctggatctgtttcacggccgttcccttagttaaggggcttgtcactttaaaaacgcccgatggcagcgtgtaagatgattttttgccttttgttggagagctggccgagtccgtcagctttaatacttggccgactttgataaaattcgggcccttgatactgttcaatctctggatggtggccatgtttacggcagttttctgtgcaattacagggaggacatctcccttcttgacggtgtacgtcgccacgccagtctttgttcctgtttttgctgataagggctgtgcgatgctaatgagcgaaccacgtttgttatgaactgtcctggccctccaaaagcttttttatcagccatcgcttgctagctgcagattttacgattttctttaccgtttccgcagattttaatacgatatactttcggttacggttcccgtcctctaagcttccaagcgggtcaaactgctgaccacttccttaccatggaagggggtcagtaaagaaataatcatcaataagaaagcctaaaaaaattaacaggcatgctgcctgttaatttttttataaccaccggcttcttaaaacagccgttttaagcttttcttgagtgacggcatttcgattttttggttttcaaagaagtttttcagcatgtatttgctgaagcccttcgcttggccgtaagtgatttttcccggaagcggcggctcgtcgccgatgacggcgtcgatgacgaccggctcatttgagttgagcgcttcatgaaaagcgggagccaattcctcgtgtttcgtcactttgatgccttttgccccgcagctttctgcaaaggcggcgtaatccatattttgcagctgggtgacgtagtcaatgttgcctttgacccgctgttcatattcaatcatgcctaaattttcgttgtttaatatgacaaccgtaatcggcagtttatatttaacagccgtcggcagatcctgcatcaccattgaaaatccgccgtctccgcaaatggcgatggactgccgatcaggttcggcaaggcttgcggcaatcgctcccggaagcccgcatcccattgtggcgagccagcttgagacgataaagtcctgcttcttcattttaaaatggcgggccatccacactgtaaccgttccgacatccactgacaggacggcgtcctctgcggccgcatcctgaagccgggcaatgacctgctgcggcttgagcggatgagtcgcttcggtttcatccttttcgatttccttccaccaatgcttcatgtgctcggtgcaggcgtccaaaaatcttctgtcttctttatattcaatgtattccgtcagctctttcagccccagagccgcatcactgacgattcccgcattgacgggatagcgcttgccgattttcgccggatccgaatcaagctgaatggcgggcgtatcatccgggagataatccctgtacgggaacgatgtgccgagcatgatcagcagatcgcattcctccatggcttcgtaggcgggctttgtgccgatttgcccgagattcccgagaaagtggggatggctgtcaggcacgacgccttttgccggaagagtaatcacaatcggagcggccgctttatcggcgaatgcgagcagctcctcttttgccgattttaacccttggccggcaagaatgaccggtttttttgcgttgttaatatattgcgcgcatgtgacgagatgttcttttttcggctctatatcggctttgaggtatatcggcgatgtgtaaaccggctcccgtttgattttttgcgcgaataaatcatcagaaacggttaaaacggcaacgccttttttgctgtaagccgtgcggatcgcctgattcagaagatcgggcagcgcttctgccgtatgtacctgctggttgaataccgccacgtcctcaaacatctgctctaatttgatttcctgaaagctgtcacggccgatttcatcggaagccacctgtcccgcaatcgccagcaccggaacgccgtccgctttggcgtcgtataaaccgttcagcagatgaacggcccccggtcctgcgattgaaaggcagacaccgatctgcccggtcagttttgcctcagccgcggcagccagggctgcgacttcttcgtgccgggtttggatgaatgtcaggttatttcgttcatgtctcagttcttcgataaattcattaatgctgtctccgggaatgccgtatatatgaccgactccccattgttcaagcagctccgtcattacgtgtcctgctgttttacttggcatactgcatcctccttttacctgtattcatccctttttcatacgggttgaaacacgggctatactctcagcttttttctcagcagatcaaggatggataacagatttcggtctttaaggactgccttacgatttgccgccccattgagtccgtcttttatttgccgttttctgttcggcaccatgaacagcggcagccggttttgggaaaaccagcgtaaatcggcggtttccgatccgttcatcagcggtgttcctccggtaatggctccgatgaaaacgtgctgtgtatcttcaaatgccggcctttcatactcaccggatttttgcaggatggtcacgttataccctgtttcttcaaaggcctctctgacggctgcggcttcagatgtttcaccttcttcaatcccgcccccgggcaaatcccatagtggaacgtcttttcgttttacgagcaatatgtcccgcccatcattttgtatgatgacaaaagcgccttgtgccatgtcgtcctcctttacaaaaaagaccgcggcatttcagcctgcggtctttccgttactttttaaaatgatacggcagggtggcgacgatgatgtccttcttccaaaacagccggacgcggagcaagaaggctgattggttgtgaaggatggtctgccagcgttttttcgtaataaattgcggaaacagcaccatcacggagaactgttcttttttcgctttttgttcgaccgtttccaaaaacttatcaaacgggtgaaccagactgcggtatgaggaatgcagggtgacgaggcggacgccgttatgaagctcttcccagcgcttttccacctttttttcgtgttctctgtcaaaggaaacatgaaccgcaatgacctgatccgataatgatttcgcatactgaatcgatttttggacgacggtggtgacaccggcgacaggcacgatgacgacggttcccttgatttcctcaggctgctgatcaacgacccgcagctgttcgccgaccgcggtgtagtgatttttaatgacgaaaaacagcatgacgacagcaggcatgaataacagcaccggccagacaagattgaacttcgtcgcgaataaaatacacagcaccataaatgaaatggcggcgccgcatgagttgatcagcatttttaccgcccagcccttcggcttctgcctgatccacttgatgcacattcccgtctgcgacagcgtaaacggaatgaacacgccgacggcataaagcggaattaaatgttccgtgcggccgccgaataaaagaatgagcaggatggacgcgataccgagaaagatgattccgtttgaaaatcctaatcggtcgcctcgtaccgtaaacattctcggcatatactgatcgcgcgctaaattaaacgccagctgcggaaaagcggaaaagcccgtatttgccgcaagcacaagaatcagggatgtcacgccttgaatgaaatagtacaccgtatggcgtccgaaggtttccgcggcgatttgtgaaataacggtctcgttaggcttcggacccgtgccgtagccgtacgccagcaccgtaatccccgtaaataagatcgccagcagaatccccatcatggccaaagtgcgggccgcgtttttcgccggaggatttttaaaggccgggatcgcgtttgaaatggcttccacaccggtcagtgccgagcagccggatgaaaaggccttcagcagcaaaaacagcgtgatgcccgctacgggcgtgccgatcggtgtatgctcggccggatgaacctggcccgtcatgagcttaaacagaccgacgacgatcaaaaggacaagcgccgccacaaacagatagacgggatacgccaaaatggacgccgattctgacagccctctcaaatttaaaatcataatcagaatcacaagcaaaacagcaatgagcaaatgatacgggtgcagggccggaaatgccgatgtaatcgcgtcagttccggcagaaatgcttaccgccaccgtcagaatataatcaacaagcaatgagccgcccgcaatcaggccgggcttctcaccaagattttctttagaaaccatataagcgcctccgccttgcggataagcgtaaataatctgtctgtaggacagaatcaaagcaagcagcaaaatgagaacacccgctgcgatcggaatggaataccaaaacgcggccgcgcttaccgcagccaaaatgatcagaatctgttccgttccgtaagcaactgatgacagcgcgtctgaagaaagcatggcgagcgccttgagtttcgtgagtttctgctctccggccgcctgtgatttcagcggtttcccaatcaaaaatcttttgattgaatggtacattttttgtcttcccctttttttcattttccgtttgatttacaaacccttactgctatgatgtctctgaataacgattgcatgccatatttcggcacagcaaaaagacacagaggcaaacggatgcccctgcgccataatcgtgcacaggtttcattcatctcctctcatgaacgcttacgaggttagctgtcggattcgggctgatgagagttggccctacctgaaaaaggattcaccccaagcggcatgacgcgccgcaaattggttcccccgctctgattacagattaagcgatatagattataaaagagatcatactcccgtcccgttcagttgtaaaggggcttttatgctgtttcaaaaataaaaaatcaccgccaaaaatggaaataaaaatacaaaaaagaggcctgttaacggcctctttttccttcattactcttcacttttttcattatccgcttttcttttttccttcttgccgtcagccagatcagaccggccgcaataattataagcgccgcgaaaacagcgatatacgtgacgttcagtgctgcggaacggcttttcgtatcaggcgccggactgctgtcgtcggatttgatttgctgatggtttgaaaacagctgcttgccggccgtttcgttgacgacggttgcggcatcgcttgtgctgtctaaaaagctgatcagctcttttgtgacagacgcgccgctgcctgataacggagcaaaaacagcgatgcttcggccggagtcccaaggtgattcctgggtaaacgcgacttgtttcgttgtctcattcagcatctgaaacgaagaaacatcgtacgcgccgctgcggtctgacggcacgagaagcttagaggcgtttgatttcaaaagcggaatttgcggcaggcctccgataaacacaacattccggcctttggcatccgcttccttcatgtctgatgccgtctttacggtaaagccgtttccgaatgaatccgccaccagagaaagttctttcagtgtctgtatgtttacgtcatccgggatgacgatcactgttttctctttcacgccgcccgcaaacgggagcggccattgcccgaaatccgctttctgcgccgcatcacttaccggatacgtcagcatgctgcttttatcaatatagacccatttattttcgtcacggtcaatacacgggttgttatgtttcaaacctgatgtgacaaattgcagatcaatgtacctgctgcttcgcaaaagcttcggatcaatcgggattgagacgtggtaaaagccatctttatcttgattgccgagatcatcaaggcgcaccgcattcggctgtccgttgatcatgacgttcagctccgctctctcggcgtcattagctgaatccgccttcgtccggatcgattccgacgtctttaatgtaagtgaaagcttgaccttaccgtctttatcaacagcggccgccgcagggtaaaagaagtgctctgacgccgttttgtttgatccgaccgttacatttcccgcgccgaagtcctctaatgtcagtttattgcctgtcttttccgcagcgggctgaaggcggccgattgtcaaagtatctccgcccagctggcttgaataagcgctgtctgtgatgacgcggattttatccgccagcgttttgtctgagtgcgccgtgacaaacaggacgggctgccgtttgtcccctgatgtcagaacccgttcggcgagaaggagtttgttgtcttccgctttgaagttcccccgttcgaaaagctcttttattttcccgttccaatgctgatcagcgccgatgacaattgacggattgctgattttgccggcatcggattcttttacataggataccttcagcctgctgtctgccgttttcagaaatccttctgttttgactgcggcttcagcttccgccgaggtcggtttgtcaggaaggataatatcggtttcttcacccgtattgcctgattgggcaaacggatacgggaaatggccgagatccgctccctttgacttgcttgcttctgaaagcacaaggcggctgtccggataaatttttatccagttgcctgacgtatcctgcctgacgcagacgccctcttttaatacgccgtaaaatcgtaatgatacattgtgatagccttgggcggattggcttttgctgagattgagcttcaccgttttccgcttggagctgccgtcaagctttatggatttgacgggttcatcatcaatggcgatggttaaagaagacggggcaattaataagtttgacgcctcgtaatcaatcagaagcgactgatcggcattcgaagctcccgcaggaatctgataggtcagctctgagctgtctttcgccccgtacagtgtcatcagatcgccagtcagcgcctgctgctcttttgcgccggcgcttgttccgagagcggaaccgtccgttttcagctcccgggccgcggccgcctgcccgttatacatcaatagcaaaaggccagttatcaatatcgcttttttcaaaaaggtcacccgcttttattttgattgtatcgctccgttttgtaccacttgacttcctgcttgaacaatcggtgcttgatctctgtgaataatgaccagatgacgagcacgatccaagcctgagagtatgtaaagtacatcagaaatacgataaagaagttttgtttgttcatttctgttttttcaatgcttaaagtaatcatgacctcagtcataaacaggaaaaaggccagtatccacaaaatcatcgccaaaaacccgactgtcagatgcaggtcgtaaaaaagattgatgataaaaatcgtgtttgacatgatcacaccgaagaaaaacaaaaaatacgtaaaaaagaaataaaacagatcgaagatgatccgcttgcgtttcagcttgaaaaattgggataaaaacttaagaacgacgtactggttgccgcgcgcccatcttgtccgctgacgccaccagaccttccatgtctcaggctcctgctcccatgtcacagccgccgggaaaaagcggatatgatagccgagattatacacgcggatggtcagctcggtatcctccgccagcgccttatcatcccagccgccgagctgttcgataatgctccgcctgatcgcgaagttcgttcccgggatggtggcgattttgaaccatttccatctgccgccctgcgccatccactgaaaacagatggtttcaatattgataaacttcgtcaggatcgttttcgccgcattgataacacggaatttcccgacaaccgctcccgctttctcatcattcatcagaccgagaaccaggtagtacaccgccattttttccggcgtattgtccgcatcatacacgcagatcacgtctccgttcgattccgcgaaccctgagttcagcgccgaagattttccttttccggcgttcggggctttgtgatgaccattttaatgaagtcatactgacgggaaaattcattgacgatgtctcccgtccggtcggaggaattatcattaacgacaatgatctcaagcctgtctttcggataatacaggttcaccatcgccttcagcgtctgcctgatgacgacctcctcgttatgcgcggggatgagcacgctgaccttcgggagctcccccatctttgcgcgccatttcggaatgttccgttcgaaggtcatataatgcctgaatccgccctgcatcagaaacatgtgatagagaagcatcacccatattaaacttaatgagataaaaaacagaatgttactcaaggcttcttctctccttaaagattcgtttttttaatgtggcgcgcaaataaaggacgtagcaggcgaacatgatgataaacaataacaccacgccggagagaatccaaagcgctttttcaagaggcgtctgctggtgatgattgaaaaaggccgttaccggatgaatcttgttttccacatgaatggttccgtctccgtccgttttgatcctgacgctgtccgacgttaccgtttgcttcgttttcttcagatcgagccactcgccgccgggaatccgctccatctgattgacgagctcgggaaggtatttcatgccgagatacggatggtagaaaccgcccgccgttccgccgccgaaatcaatcatctgagaaatatgattctccatatctccgagcggattttcctttgagttatcggcataaccgattgtttcagggtacagcgtcatcccgtccagcatagccggctttgagacgaacggaggggcgcccgaggttttccacgtcgcgccgctgagctgcacttgtccgaaaatgctggagaaataagaagatgcgattttgtagccttcttcagacatcgtgtagtgcggcgcttcgaatgacagcgggtaaaggccgagctctgtcagatcgtcaatcgcctgctccagcttcgttctcgtgtagatgttttctttttcacggaaaggcttcacatacgcccggtacgctttttcattcggaaaatcctgttccttttcaagcttgaccggagtatcatccgcattttctgacgtaatcggctgatccgctttggcatcccaaaattcaaagccttctcccgtttcgctgtatcggtatgcgtgcgtgtagccgtgaataatgatgctaccgcccatttgctgaagttttttcaggacgctgaccatttttggcttgtccgccaggtatactttttctccgttttccggattgagatagaccggaatgaccgccagaataaacggaatgtgtcttttatgcaggtaagcgcccgcttcgtaaagcaatctttcatctgacatcggactgatgtcttcaagccgcaaataaaggagggtgccgccctctgattctccgaatgcgctgcgcatcgctttcgccgtcagaaacgaatcatttaacaggctcgtcacaccgaaataatagtcagagcgcgccgttttccacataaaagggcgggtgctgccgtcaccggaccggtatgtataaagggactttccttttactcccgatacgccgagcacggacacccccttttcaagcggcatgtctgttttttcttttttgccgtaaatgcggtataccgtttctttttctgtcagggacaaccccgcaaattggcggaactgtccggcgttatagccgatgctgataagctgctgcggcatgctgctgatcagtgacacaaatgatgtgctgagcttttttttcgtgacgccgtaatagatgacgcgccgattctttttgaagtccgcggctgtgatgtctccgtcgcttttcacggtgacggcggatgagaaatggcccgcggtcagatcaagcattttgacctcagcggtttctttgccgtccgtgcttgtataaataatgagaatgccgtcctttttgtcttttgcttccgccggacggggaacataaaccgccgaaatcatgaaaagcgccgagagtaagagacgtatccatttagagttcattcatcatcatctcgttttccagttcatttaaaaattgctcggccgtttgtaaatcctttcggtacgccaagtaacatacacggaaggtgatggagacgtatttaccgttttgcagccggtacgtatccaattcctttttcagcttcgccagaacggccggcatgttttcttcaggcgtatgggtcagcacgatgccgaaccgttcggcggacggcctgaattttttgtctgtttcccgaacgcttgaccggatttggcggctgataaacgccagcagccgatcggtctctttttctccgtatagggatttgaattccttgaaataatgcatgtgcagcagcaaaaagacgaaggaattgccgtagcgttccgcccgcttgatttcctcggaaagctccagcttcatccgcagatggttgtcaaagccggtcaccctgtcgacggcgacaaagctcgtaatctcttcacgcagctgtttcactgagcgttcaagccccttcgccaactcgtgaatccttcccgctatgtaagaaaagagcagcagcgcaatcccccaaatgaccagcacctgcagactttcggcatcggcagacgccataaagctcccggtctgaaaccacaggagcaggctgccgagaacaaataagacgagtaaggtcatgacgagcgcgtagattgccccgaaccatataccggctcccgcaacaagcaatgtgatgcaggttatcagaagccctgcggattgctgagacgcatagtaaataaaaaaagacagcagcaccagcataactgctgtgtagctgcacagtttttgtgattcattgaatgatattttcattaaacaatttcctttcagccagaagcggcagcaggttatcgaaagaatgtgtatcgctcccgctcatatagccgccgtaatcgggtttcagcgtgtccagtgtttcaaatgaagtcattctttcataaagcggcttgatgacagccggatcagctttttgttctgctaaaaaaagaacggccagggcgtaaacggacggtgattcgtactgaaccgccggctccttcgtgtctgcgctgtatcgtccgtacagctgtccgcgcgacttaaattcctctatcatccattttgacagcgcggcagccttgccatcgccccgcttcagattcacggcggcgtacagctggtcgatgacattcacttcgctgtcatatttgtattcctttgtttcggtattgaatgatttcggcagaaaaccatttttcaggggagctcgattgagaacatcaaggttccggttttccgttttctcatcgataatccctttttctctgagcatctgtaaggcgccggggtcaacataggacaaggtcacggtctttgatgcggcatttgaagcggcatcataataatccgtaaaatacccgtcatttgtattgtatttttccagcgccttcccgatctgcaccgctgttttcccgtattcactgtttccccacagggttccggcctcattcagacagttcatgattctgaaatcgtcaattaaggcattggtgccgctcgctttattcccgtcaatcttccacgacacgagcccgtttttcgtcagaaacgaatcggtgagaagctgatattgcgcttgaaactgccgttcatctttcctgttcagcaaaaatgccatccatagtccgagagactcagataaatattccggctcaccggatatgttcgtccggatcatcccccgcccgttcatcaatttatgataaataaaatgctctgcgggctgaagcggtccggacggttcggccgccgtctgtttttcaggtccggcctccgcgcaccccgccgtcagaacgattgaaatcaaaaggatcatcagacgaaaaacgaattgcttcacagtccatcctcctattttacaaatccttttttagacccatatcttattttttcacaaagtatttttactataaaggaaacgataaaagaatactagcattttttcacattggaaaattttaaatggaagcgccgcctctcaccttttccctcttcacatggatcgtattcccattacagtaaaaaacacaacaaaaggcagcatttctttacaaatgctgcctttctctgatctatttatccaggccgagttttttcagctgttctgccagcgcgttgttcatcggctcctctttgttttggcttttcatataagagttaatgtcccgcttggatgcgcgtccggatttatctttcgccttccgcttttcaaagacggacagtttctcccggtggccgcatacacatgcgaaggtttggccttcgccctggccgcgaagctccattttcttatgacagttcggacagcgggcgtttgtttttcttgccagcgttttccggctgccgcactcacgatcctgacatacgagcatcgtgccgcgtttgccgttgactttaagcatcattttgccgcaatcagggcaggcggtgcctgaaatgttgtcatgtctgaaagtctggctgctgtttttgatctccttcaccgttttgcccgcatatgttttcatgtctttaatgaacacggcggatttcagtttgcccgctgcgatggcggagagcttttgctcccattcagcggttaaggccggcgatttcaaatcttccgggacgagctgtaagagctgcttcccttttgacgtaatgaaaatatctttttcttttttctcgatcaagaaactgttgaacagtttttcaatgatatcagcgcgggtggcgactgttccgagtccgccggtttcacccaatgttttcacaaggttcttctcttctccctgcataaaggcgcttgggttctccatcgcggataacagcgtgccttcattaaagcgcgccggcggtttcgtctgaccgctcgtttctttcaatgatgagacagtgaggcgctgcccctgctgaagatccgggagcgtctggtctttgtcttcctcatgatcgtcgtcatcctcgtacatatcatacacggctttccagccaggcgattgaaccgttttcccttttgcggtaaatgtttcgccgccgatatcggctgtgacctttgtttcttcgtattcgaacgccggcattaacacggcgagaaaacgtttggcaatcagatcgtaaagctttcgttctttgtcgctgaggcttgaaaggatcagcggctcctctgtcggaatgatggcatggtgatccgatactttcgcatcattgacgaatcctttatgcgctttgacgccccgcttcagtatttgattgacgtactgggcgtacggcttaacttccatgccgtttaaacggtcttttaaagtcggcacgatgtctgcggaaaggaatctggaatccgtccgcgggtaagtgacaagcttatgctgttcatacagcttttgaagcacggacagcgtctcttttgcggagaaaccgaagcgcttatgagcgtcccgctgcaattccgtcaagtcgtaaagaccgggagcgaagctttttttcgccgtttttttcaattctgaaatgactgccggctttccttgcaggtcttttgccaaacggccggtcaccgtctgatcgaacgttcttgtctgttttgtttttttatcctgccatgtcagcgtcatctgatcagccgccgcgcggaggccgtaataaggaacgggtttgaacgcctgaatatccgcttcgcgtttggcgatcatcgccagtgtcggagtctggacgcgtccgcatgacagctgcgcgttaaatttcgtggtcagggcgcgggtcgcgttgatgccgacgatccaatccgcttccgctctggcaacagcggaatgatacaggttttcgtactctttgccgctgcggagcttttgaaatccttctttaatcgccttatccgtcacagaggaaatccacagccgcttaatcggtttgcggacgtttgccttttcgataatccagcgggccacaagttccccttcccgtcctgcgtctgtagcgattacgatctggctgacgtctttccggacaagctgagctttgaccgcattgaactgttttcctgtttttttaatgacgacgagctttaaaggctccggaataatcggaagatcctcaagccgccatgattgaaattctttgccgtatccttcggggtcagcgagcgttaccagatgcccgagcgcccatgtgacgatgtagcggtcgccttcaagatatccgtttccttttttatgacacttcagaacacgggccaagtcccggccgactgaaggtttttcagctaatacaactgtttttgacatgcttttcacttctctttctttcacactcatcctgttattataacagacttcctcacgctctctctaatcgaggacgttttttgtgtcaatttctgagaaaatgacgtgggtcacggtttgggcatacggagaggtgcggttgatgaagtgttcgatcgtttccagactgtccgcgttaatcttcagcatataacacgccgccccggcgacccgaaaacaaaattcaatgttgggaatggattgaatgtaggttttgaattgatcgtattttccgtttttcaccgtcgcttcgacaatgcaggagacggggagcccgatctttttttgatcaatgtccaatgtatagcgcttaataacgccgaaggattcaagctgtctgacacgctctgtgacggacggggctgacaatttgatttttctgcccagctcccgcatggacaggcggctgtcccgctgcagctctttaatgatgctcagatccacattatctagtttcatgactgtagtccttccttacccttttggctatattatcaagagaaatccgaaaaatgacaagaacaacaggctgaaatcatgaaggttttttcaggaactgacgcgaaatggtcatattaggactgccctttgcttatagtatagaggaaaaaagatgtccgacaggagggagctgtatgttacacacgccgatcggcagacttcgcacgatggggtttattgaaggaatgtcgcttttggtgctgctgtttatcgcgatgccgctgaagtattgggctcatcatccgctcgccgtcaccattgccggttccattcacggcggtttgtttatcatttatctggcggtgctggcgtatgcggcgtttactgtcaaatggcatgtgaaatggtcagccgccggttttatcgcggcctttattccgttcggtaattttatttatgatcgcggcctgagaaattatcaataaaaaagctcctcttctgcagaggagcttttttcatgcgttacatccatttcgtcacccaggcgatataataagcgccggggatgaatacgagctgggcgagaagcgtgcccgcgacccttgatgtgaccatcgtcaatgaggtccattttaaggagacgtagctgcgcttgcccttcgccacatcgtctgccagtacggagactttcgggtcaacaaacacggccagcagcatagtcgcaacgccgttgattaagcctgatgccataacggccgtcgtgctgtgctcaggcgccagaaggccggcgtacagagcggacagaacaccgatcgtgtaaatagacgtaatgaccatattaatgacaaacaagcgtttcggaatcattcggaattgaagcccctttaaataggagactgacggcagtctgatataagaacgcgcatgcttcagcccgttcagtgaaaatccttttttaaatacctgcatgacggagcctcctccgtccgccaagtgtataatcgccctggagaataacgcgacgaatgtcggcaaaagacagatgccgagcatcgttccgaccgtggagccgaatattaaaaatcgaaactgagcgcccacaacagacagagcgtttgatccggcggcatcaatcagatgtccggtaaacggctgctgaaccatgtttgacatgcgcgacacaataaccatgacattaaataatgacagcgcggacgcgataaatccgactctcgcgccggaaagccgtgttgcataggcaagcgtttcaatcgaatgtatcagcagcagaaaacagaagataaacagtacttgtgaagtaataacgtgcaatgtatgattcctccaaatcttttcatactgattagactctgcagactgcggcaaggtttcggccgtttacataaaaaaaccgcccggatgtccggcgcggttttgtcttattcttttcttacgcaaataaataatatatggttgcccgccttagcctgcgggtgattcgtattaacagttccgacagaatcattcttcgaaagtaaacaccatggaagttcttgaacacaagacaacgaaagccctacctctcaatcgtcactgcggctccgaagccgcgccggtgtgaattgtaaaacaaaaagtcttttttccatctcttcgttaggggcgaatatcagaaggaaaagaataagctcagctttttttcaagctgtccgttgaagcctgaagcttctatatcaaaacagaaaaaagaagtttactttcttttttatttgcatgttgtcacttagcagttaagtataacagattgcccctgaataatcaaatgatttattaaagttccagctcggccggcgttttttcacccgcattcatgagcttgatctgcttcggttcaatttcgagaatcaccaggttcggatcgtcttttccgtcaaaccagcgttccagtttcggatcccacagcttttcttttaaatctgctgagttgttcagtttggcggttccggccacttccacataagcgtcaccgaatccttcacagtcataccctaacagaatatgaacattcggattgttttcaatttcttccgctttatgagtgtctttgctcgtcggcgtgtaaatcgttaagccgtcatggaaaaatgtcatgtagcgtgaatgcggtttgccttgctctaccgtcgcaagcgaaccgactttatgatgatccagtacttcaagcactttttctttgatttcattttgattcatgaagaatcactcctttttaacgtctccgctgttacttttccacattggggagacatttaaaccaagaaatgtgctcttctgccgatcttcgctccattcccgcttcagcatgctgtagttcaccgtgtcatgataggcgccctgtacaaaaatgccttctctcgtcagtccttctttctgaaatccgagccgttccgccaccgccctgcttttcgtgtttttttcagccgcgctgatcatgatgcggttcagcccgaggtcctgaaatgcatgggtgatgaccgcccggcagcttgcggtgataatgccgaatccttcatgctctcgatccagccagtagccgatctctgctttttgattgactgtatcgacattatggatgctgatcatgccgcaaaaccggcccttcacaaaaattccggcgtcaaacccattctcttccgcatatttatagcgccattcggggatgatcacatcgcggtacgtatcgatgtcagccagttcttccgcccagctgagccattcgctgagatggttttgatttcgcttcataacagaatacaattcgtccgtatcttctttggcaagcaatctgatcgtcagatgttcccggatttgacaggaaaacacgaccgcaccttctttcctttattagccattatacaggtaaatttatttttttccatacaaaaaagatgaggcgtgcagcctcatccttaaatgcgcgggtcggtgaaaacatcgtgatcatccgtgcttgtcgatgacatttccgtaacgaccgccccttcttctcccgcttgaaaccaatgcttcgtatccggcggaatggtgtattgtccgcccggctcaagcacaatctcatgccagacggtgtagtattccttgtcttcttccggcgggaggacgcttgggttctctgtcttttcgccttccacgtagagatacaccttcccccagcggcatcggaatgtctcttgttttcccttctcgccgccgaccggcggatggcggtgttccggacacgtctggcgcgggaagagcaccaattctttcgaacagtagcggtcggtattcacgtaaataaacagctgaagcccggtttcctcaagcttgcctaagccgtaatccatgatttgaatgtcttcgacttcatcatcagtcagaacgattcccgctttttgatagtatgcattcacgtcatgtttcgatatcgtcatcggtcagcctccttatgtggtcacaaatctgccgccgttgacatgcagcgtctgtccggtcatataagaggattcgtctgaggccaagagcacatagcagccgacatgctcaacaggctggcctgcccggcccatcggcgtatcctgaccgaaggaagcgactgtttcttctgagaatgtcgccggaataagcggtgtccagatcggccccggcgccacggcgttgacacggataccatcgttgacgagcgcttgcgccatggatctcgtaaaaccgttaatcgcgcctttcgtagccgtgtagtcaatcagctgcgggttgcctgtgtaaggattaatggatgtcgtattgatgatcgcgctgcccggcttcatgtaatcaatcgcttttttagtcaaataaaattgtgagtaaaagtttgtcttaaaggttctgtgaagctgctcgcttgtgatgtctttaatgctttctttcggatgctgttccgcggcgttattcacgagaatatcaagacgcccgaattcttcaaccgttttttcaacggcttcattgcaaaagtcttcctcaccgacatcgccggggattaacagacattttacgccttcttcttccactcgtttttttgtatcttccgcatcatcgtgttcatcaaaatagacgatcgcgacatttgcgccttccttcgcgtaagcaaccgcaacggcgcgtccgataccgctgtcgccccctgtgatgagcgcggttttcccttttaatttgtcagcgcctttatattctttgtattcgtaaacaggcgccggattcatttcgctttcaatgcccggctggcggttttgtgattccgccgggaattccttcggatagttttccatgtcaagttcctccttctggttcgttgtcatatttcttgtctacctctgctgtcttccggataaacatgattgagacagttcaaaacgttttcggagaaaaatgtttcacatggaacgcaagaaaaaaacccggctggcagccgggtttttgttctctattatgaacgtaccgcttgtttgcggagcacgtcttttctcacttttccaaggttgtttttcggaagttcgctgacgaactcaatgtccggaattttaaaggcagcaagacgttcttgaaggaatcgggtcacttcttcttctgtcaggtcttctctgccgtttgtcacgatgaacgctttcggcttttcgccgtagagcggatcagggataccgacaaccgccgtttcgagaattcccggcacttgctgaatgacttcttcaatctggtcaggataaatattatcgccgccgtagatgatgacatctttataacgtccggtgataaagataaatccgtcttcatccacatagccggaatcgccggtatggaaccagccgtctttcagcacttttcgtgtcgcttcttcgttaccttcgtagcctttgaataaaaacggacttgtcacaacgacttctccaattgagccttgcggaaggacttcacctgtttccggatctacaacgcggacgtccacttcttccatcggtttacccgcggaagcggctttatccattcccatttgcggattccaagagctgatgccccacgcttccgtgcttccgtatccgtgcatgagcgggatgccgatgtcgagatactgctggatcaggctgcttggcacctttgtgcctcccgtcatcatataaacgatagaagacatgtcagtctggtgcgtttcccatgctttcagcaggtatgtgaaatagactggcagcgccatgatggtttgaattttttctttttcgatgagcttcaagttttccacagggtcctgattgtctgtcataatgaatgtcgttccgctcatcgtgccgaccatctggcagataatcgcgctcgtatggtaattcggatggcatgctaagaagcggacatgctgcattctccccgtgtaagccaatgtcgcgtttacgtagttgtatatgccgccgtgagtgatcatgcagcgtttcggattgccggttgtacctgaggtaaacatcagcaatgccgtatcgttttcagacaccgtttcgacatccggtgtatcaccggagcctgtcaataaagcgtcaaactcaggcgttgtctccgcagctgttcctgtctcgatcttcagtttaagagaagataccagcgcaggaagaacttcttccataatctctttaaattcagtgccgaaaaagacagctttcggttcacaggctgctaaaatgcctttcatttcgtaaggtgttaattgccagctgaccggcacaacaaccgcgccgatttcgagtgccgcaaacatgacaatggatgacgcgtggccgtttttgcaaagcatcgccactctgtcgcctttttttattcctttatcaagaagcgcttgtgcaagctggttgattcgttttcgatattccgcgtaggtcagggtatgcgcaccgctttttacagcttcgatctcttcgctatttgaaatgtcatgcagaatcatatgctgtaatgtctccatattttcatctcccataatcataaatcacaaaaaactctgtcagattttcttcctcacgcaacccattttaaaccaaaaaatataacttgtaaaacaattttgttttagaactattccattcgtgaatgatacaatagtcccatgtttttagtttcttcccttccccttaccctcatacatgcagaaaaaaacacaccccatatgaggtgtgcgctttctgtttaccgctgtcctttctcctgaatgaaatgataaaacagcttgtttaaacgtttgtataaatcggcttcatcctccgtctggaaggcttttatactgtcttcggactcgatgatggcggagctgaccgcacttagtatttccgacccttcagcgggcatatcagccggcgccatcatcaccaaagcgcggccgacggtcagggaatttccgtccatgcctttgacactgcatggagctgtcaaatcataaattttgaaaaaaggcgtgacaatttcttcatttttgagatggtacagcgccatcgccgttcccggaatgccgagtccgccctgtcgttcacgctctgcaaggcgctgtgcggtttgtttggcattacggacaaatccttcttgctcaagcatggcaaacaaacgattcaaaaacagttcgtacgccgtgtttgactcaatggatttgatcgaaaagttccgcagcacgctttggataaccgccgcataatgtgccatacggccggccgcttccagcatatcaggcgtctccggctgcttctcttctcttttaccgtttctttttttgtcaagaatcagcggaatttttcttttgatgtactgcttcacctgatcagcgtcttcttcgtttaaaagcggactgaccatgacgtaatcaatgtttccatacgggatcggaacggtggatacgatcatgtcatacgcggtgatgtctcggtccttcagttcgatgagggaagacatatcaaaggaacggatttccggaagctcctttttcagtctggatgcgagcattttggacgacccgatgccgctggaacagacgatcagcgctttgatcttcgcttcttcccgtttgatttccagagcggagccgaagtgaagaacgatgaaagcgatctcatcatcagagaaaagaagccccggaaagaatttttccattccttcttctacggccatgtacagcagaaagtagtcgcgtttaatttgctcggtcatcgggttgtacatgtcgatattttctttcacccggttgatcgcaggctccagatgggcgattaaaccgtcgtataaagaaccgttttccgtcagatcaattttgattttttcagaaatgaagccgatcagctgcttcgtttgcaaggccgtttcaacttcaatgttttccggtttgaattccgttttgtattggcggttggcgctccgcaaatgaatggtgatataaccgatctcagcttccggaattgaaacgccaaacgctttttcaagctcttttgccatttccatcgcagagccgtactccttcgtctgctgcagcgcttttagttccgaagcctccatcgtgatggtttctccgagtctgattcggtccatcgcaaaggttaaatgaaccgcaagcgccatgtatgagctgtcagataaggcgatcgcgattttttccttgagctgaatcaagagccggtccattttcaaaagttccgctttatttacgaccccgaacattttttcagcatcgtcaggttttcctttaatattgaattcaaccgcttccaaaaagctctgaatatcaagccggttgacgatgagattgccgacgattttccgtttcgcattttccggacccgtcagctgtatgccgaagcccctttttcggatcagcgtcaagccgaagggcgcgatccaggtctccagctcatccagatcataactgattgtcgcgtttgtcacttgcaattcgttcgccagactgtagagcttgatcggctcttgcgactctaatagtgaacatagaattaaaagtttccgctcctcagcgctgtattcatgctgttcataggacaggtctgacaggagtttttgtttgtcctccgggtttcctaccgctttcagtcctttgccgggctgtttatcaagtgccagaccgaatgattccatcatcggtttgattgtttttaactcgcggtgaacggttcttgtgctgacttgtaaagcttctgccagttcatgcactgtctcgtaacggttctgcagtaatagatgtttcattaatttttgttctctcgctgtcatatacatgaaacgcgcctccagattttctagttgtgagaagtatggcatatggggagtgctgccggggaaagtggtgtaaattataatataaaacgctttcaatgattattcaaccattttcaaatggcaatttggcactggaccgtgtgacagtattgaaaaagaaaaatgtgtcagataatatgccatgacgcttgttactcttgatccgcacggctatacttcaaagtgaccttacttgtttttagacattgcacaccacataaacaaacgcccggaagataccttccgggcgtttgttctgtttatggaatatcgcagccttggacaccggtataaatcctgaaccactgatcatggctgagtttgtacgcggatgcacgcaccgcggcggaaatgcggttctcttttccgctgccgacaatcggcatgatgtctgccgggtgggtgaacagccatgcgtacatgacttcgtcaatggaagcggcgccgatttcttcctgtacggaacgaagcgcggcacggattcggagggccttatctgattgtcctgtaaagacgctcccgcccgcaagcggtgaccacgccatcggcggaatgcgtttttccagacagaaatccagcgtgccgtcatgaatattttccagcttgtacgccgagatttcaatttggtttgtgacgagcggatcatccaaataggattcgagcattctgtactggtgcgctttaaagttcgataccccgaaatatctgaccttgcccgagcttttcagcgcgtgaaacgcttcagccacagcctccgggtccataagcgggtccggtctgtgaatgagcagcacatccagataatccgtattcagattcaaaagcgactgctccgccgacgctaagatgtgagacttcgacgtattataatgatgcgacttgtttcctggccgctccggtgattcaatgacaatcccgcattttgtgacgatttcgattcgctcccttattgaaggcgaaagggacaaagcgccgccgaacagcttttcacacgtataaccgccgtatatatcggcatgatcgaaggtggtgatgccttggctgatacaccattcaatcagattcagcagctctccgtctgaaacattccattcgttcagacgccaaagcccgtgtatcactcttgaaaattccaggtcttcagccaattgaatgcgctgcatgtgaaatccccctttttcttagagcctcttgtatctctgttttcaggaattgcccatgctgtttcattctgcttcggcggccgattttcctttcagcccgcaaaaatcgtcatttaatgattctgaaactgctttttcgctttttcaacgacgtaatggcttccgccgcgttttttgacgtcttgaatcatcatcgcgatcaagaggtctttctttttataatcgtaaccgacaaaccagccgttttctttgccgtctttatcttctttagacgttttcagctcggctgtaccggtttttccggctacggtaatgccgcttacggccggctgatatgcagagccgcgcggatcttcaacgacgcctctcagccctttcgtgatttcttcggcattggctttcgacaccacttgcttatgccagatttgcggtgttttttctccgtctttgatcaatgtcggtttgacgagatttccgtctgttacaaatgcggtatagtcagccgctaagtgcagcggagacatcagcatctgcccctggccgtagcccgtatctccgagaaggatctcggaatctagcttgccgttagcgattgaggacttttcaatcggaaattggtacggaatctcttcatcaaagccaaatgtttttaatccttttgtaaacgcgtccgctccggcatctatggcattttgcgcaaagtagatgttgtccgatgtgatcagcgcgttttcgagatccacttcattcaggcgctctgatacgcgtgtgacatggtaaccgccccagctcgaatctttctgccactcttttccggtgatttttttcttttccgatgctttcaatgtgccgtttgtcaggccgactgccgcggcaatcggtttaatcgttgatcccggcgcataaagtttgttgaatttcgctgaaaacggattgtttttatcttcattcagctttttccactcttttccgctccagccgaaaagaaagccgttcgggtcataagacggtgcgctgacgagcgcgagtgtctctcccgtttgcggttcgagggcgactgccgctccgctgtcatctttcatagaatcatacagcttcgtctgcgttttcatgtcaatcgttacatgaatatcctgcccgctttcggctttcttttcagcaatgacctcacctgtttgcgggacgtaaattttccagccggtcttgccgcgcagcttgtcttcatatacattctcaaggccggcgatgccgattttggaagtatcgctgtattggccgtctttcgcttttttcagctgctccgctgtgatggttttaatatagccggtcagatgggccgttttttcgccgtacggatagtagcgggagctgactttcgttttcgtcacgccgtctaatgcaagcaggcttttgaccttgctttcatcatccggtctgattttttgaatcgggacataggagtcgtcttttacccagccctggttcagtttgcttttgatatcgtcttcagaaaggtccagtttttcagacagtttttggatcacgctgtctttatccttgccgagttttccagggataatgccgatttccggcacctcggtattcacggcgagaccttttccgtctttgtcgtaaatttgtccgcgcttcggttcctcatttgcgatctgcacggttttgtcatcggaaagctgtttgaaaataaaagaaggattccagtcaatgttccatgattctccatcgtctgttttctcttttttcaggacggccgtgttttcaaaagcgaccttccctgcttttgtatccatgctgactttataatcgatgtgctggaggtcatcttttttcttatcgtcttcgtcctgtttttcggcagtgactttcagatttttgacccctgcttgttcataaatggtttcatatcgttttacaaaatcctttttggatcgttttttcttttcatcctgggtgaggctttggtacatcttatcgtaatgaccgccgttccagtcttttacgaaatctttcattctgtcttcggccgattccgttttcgagcagccgatcaaacctatgattcctgcgagtaaaagtaataggtataacccttttttcactgtcaattcccctgccttccaactgttattttctcctaaaccaaatcaggctggcaaggatttttttctcatagcgtttaaaatttttttgtttttccggccgtcacggcccatatttttatacaatgtatctattaaaaaaggaggaatttcagatgatcagagaagcagccatgctgtatgtaaaagaaggtcttgagggggaattcgaagaggcattccgccgggcggagccgattatcgcgggcatgaaaggttatctgtcccattccttgtccaaatgtatggaaaagacgcataaatatttgctgcttgtggaatgggagacattagaagatcatacaaaaggctttcgcggatcgccggaatatcaggagtggaaagccttactgcaccgtttttattcaccatttcccgttgtggagcattttcaggatctatcagactcagatcgcgtgaagcgtaaaaccgattaaggagatcgaccatacaaaaacggcggtatagatattgaatttcccggagccgtcgttttctttccgtttttcctccagccctgaatgaacatgaccgcaccgagaaacacgagcataaccggctgtatgacggaggtatgttccgcatacgtaaatgcggcggccgcaagtataataatcagcatcgcgagtgacagttttaaggcgcgcagcaaagcaatccatcctttctgttatcattttttgaacacaattctatttctgtctttatcccccattattctagcgtactttttgcgcggatagaacgaaagtcggacaattttaagtttgttttaaggagcacgaaaagcgcgctccccatgaaaaggagcgcgcggtttatgagcgggcgaggcttccgtatccgagcccccgcaggacgcatgccatgacttcataccccttgctgttggggtgtacgcggtcataagaaagatattcattcatttttcctttgaaagcgctgtggacgtcggcaattttgacgtgcggcgccgatgcgagtgtgctgaggtgcgcattataagaggatatccatttttctgcaatggagatgcccgggaaaggattgtataaattgaagacgcggatctcataaggagacgggtgcgacccttttaaggcagcaatcttggttatcatcttttcaaagttctcatggcagtgactggacacgctggtgaataccgaagcgtccgatgtttgctgatatgcctgaaccgaatcgatcaaatcgttgccgcagcctgtaatcgtaatcatatcagcagcctgaatccgcctctgaatgtacgggaaggacataagcccgagaatttctcccgtctcaaggcctgatttggcaaagatggatacgtcggttcttgtctgtaaatcttctgccatcatgcgcccgaaccgctggacaaaaccggcggaaaacggcccggatcccctccccgtcgtcaaagaatcccccagcgccgtataaacaagtcccatttactttcctccactcgttactatcgatattgtaatgtacgcgagtgaagaaaaattggctcggtcaataacctaatttctcagaaatatgctgtgcggcgtttttgaccttttcggttaaatacggcagcctgtcctctgaaaaccgggcttcgaagccggcgatgctgattccagcagccaccttaccttcgtgattgaaaatcggcgccccgatcgccgccgtataatcttctaattccgaatagctgatcgtataacctgattgcaaggatctttcaatggagtgaagcagttcagcccgatccgtcatcgtgcctgaggcgattgcggcaagctttgtcttctgaatgtatgtgtcaatctcctcttccggcagaaacgataaaatgcttctggcgcaagctcccgcgtacagcggcgaccggcggccgattgccgtatacaggcggacggtttgggtgccttcaattttttcgacgtaaatggcttcatccccgtccctcatgatcagctgaacggcctcatccacttcgctgcacagctcttccataatcggtttggctattttcctgatatccagacgttcagagacgagctggccgaattgtaaaaagatcagaccaagctgataacggccgtccgccgcccgggtgagaaaccctgtttcctccagtgagcttgccatccggtgaaccgaagtcttcggcatttccgatagagaaaccagctcatttaagctcaggctcggttcagtgagaaacaaatgaagcagttccattgatttgatgacggttttgtttttgttttccatggtctttagcccctttgtcagatcagccattccattttgagccttgctttcagctccttcagctgctgttccttctccaaaagcagcatttccgcttcctccagcgaaacggcccggaacgtaatatgttcccccggcatcgtttgggcgacgaggggaagatcggcggatatgatatgcgccattcgcggatagccccccgtcgtctgtctgtcagccagcagaataatcggattgccgtccggcggcacctgcaccgttccgaacgtcacagcctcagataccatttccagcggctcccgcaattcaagcggagcgcccttcagccggtagcccattcggtcggattgaggcgtgaccgtatatgactcttgataaaaacgtaattttgcttcttctgtaaaagcgtgaaattgagcgccttcaagcactcgtatgaccggattttttttcagcggcagaaaccctctgctgctgacagaccaatcaggcgctgagaaaccatactgtccgaaagaatcgctcagacggtacgcgattgattccgaacatggcgtcatacggccgagcggcagctcatcatctttttgcagcgctcttccgcaaaagccgccgatccccgctctgacatacgtgcttttgctttccatgacggcgggcacatcaaatccccccgcgacggcgagataagcgcggctccccatcttgcacggcccgaatgagacgacgctgttttcctttatcaaaaccggtttccacagaggggcgggctccccattaatatgaaaggcgaaatccgcccccgtaacggcaataaccgcgggttctgagaactcaaaggaaggccctggccccataagcgtaacttcaagccccgcctctttttcttgatttccggcaagaagattggcgatgcgcagagagatcgtatccattgcgccgcttcccagcacaccgtatttctgatatcccgtccgccccgtgtcctgaaccgtcgtcaagagaccgggttttaccactttcatactcattcggctccctccttgatgcggctgtactcctctgctgtgatccggacgaatttcaccgtatcacccgctctcaatagactcggcggatgttcttccggcctgaaaagccggagcggggtgctgccgatcagctgccagccgccgggagtggatatcggatacacaccggtctgcattcccgcgattcctactgaaccggccgggatggacggccttggcgacgcctttctcggcgctctgatccgctcagacattccacctaaaaacggaaatcccggcgcaaatccaagcatataaacgagatattcgccttcagtatgaatgcggatgacgtcttccggggtcagatcgttcatttcagcgacctcttctaaatcgggaccgaaatctccgccgtagcaaacggggatttccatcacccggcgctcttttttgcggccggtcattatatggctgagacgttctgtcacttctttcttgaccagggcaaaaggagagacgcctttttttatgtttgagacggcagacacgtcataaaagaccgttaagcttgtgaatgccggaatacattcaacgaagcccggaaacggccgttcttccatacaggctgccgccgcctgcacccggctgttgacctcttcgctgatgtgcccgccaaagcggatgataacggcggaatcaccgtacggctgtatatcaagcgctgtatttccgctatactgcatcattgtcatcacctcgttgtattctttctcacttacaggacagcaagcgattcattttgtatatcggtgatcagcatgtgccccggtgaatgtgttattacgatatcaggctttgcttccatgatcaccgcctggggtgtaacgccgcaagcccagaatacgggaacttcaccttcccgcaccgttacggcatctccgaaatccggctgatgcaaatcgctgatgccgatgctttgcggatttccgatgcggacgggggcgccgtgcacggcgggaaaacgtgacgtgacctgcgccgcgcggactgccagcctttccggaatcggtctcatgctgacgaccatttttcctgaaaacgggcccgccggaatacagtcaatatttgttttatacatgggaacgttcacgccttcatcgatgtgcctgatcgggatgtgctgattaataagggcctgctcgaatgaaaaactgcagccgatcaaaaacccgacataattatccttccaatacggcgtaatatccgttacctcttcagtaagcacgccatgccgataaatcctgtatttcggaaagtccgtccggatatcagctcccggcgccgctattgccggaacgggtgaacccgcatccgtcacatcaagcaccggacaaggcttttgattacgctggcagaataagagaaaatcaaaggcaagatccttttgcaaaacgacgagattggcttgtgcgtaagaagcggccaaccccgccgtcggcccggtcatctgccctttcctgataagctgtctgacttcttcgggactcatatcactcatatggtttttcatatcatcagctccatagctgcggcatttgcgagaataatgtatagatgcccataaccgccatgacaaccactacgatcgcccctgcaatcgtgagccagatcggatgcttgtaatcgccgacgatttttttcttataggcgcccaacagaatcatcgctaatgcaagcggcagaattaagccgttaagcgaaccgaccgcgaccagaattttggcaggctggccgatcgtgacaaaaataagagtggatacaataataaaaccgataattacgccatgtgagtgcttttcgatttttgccgaaaacgatttgaagaatgacaccgatgtataggcggcgccgatgacagacgtgatagcggcagaccacatgatgacgccgaaaattttatagccgacatttcccgccgcaagccggaatacagaagccgcgggattatcaggatcgatgcgcaggccctttgaaacgacgccgagcacggcgagaaacagggcaatccgcataacagatgtaatcaagacgcctgtgacggagcttttcgtcacctgaggaatgacttccttcccttggatgcctgaatcaagcaagcgatggcctccggcaaatgtaatgtatccgccgaccgtgccgccgacaagcgtcacgattgccagcacactgatatgatcaggcataaaagtttttacaaccgcgtgtccgaccggcggacccgtcgttacggcaacatacaccgtcaatacgatcatgacgattccggcgatctgcataaaacggtccatgacttttccggcttcctttatgacaaaaatcagcaccgcgaccgctgcgctgattaaagcgccgatctccggtttgattccgaataatacttgaagaccgagacccgcgccgccgatgtttccgatattaaacgcaagtccgccgagcacgaccagaaaagcaatggcataaccggcgcccggaagcaccatattggcaatctcttggccgcgctttccggaaaccgcgataatccgccatacattggtttgcgcgaaaatgtccaaaataatagaaattaaaatgataaagccgaagcttgccgccaatgtattggtaaacgtggccgtttgcgtcagaaagccgggcccgattgatgatgtcgccatcaaaaatgtcgcgcctaaaagaagcgaccatttgccggaagcctttccggctgtttttttcttttgctccatgctgtcttcctccctctgctgctcagtcttttgcaagcgcgctgatttgaatgtctgccgcttttaattcttttttgattgtttttgcgaatgtcagcgcgtgggcgccgtctccgtgaatgcagaccgtgtccgctttcaggtttacagcttgtcccttacgtgatgtcaccgtgctgtctttcaccatttgaatcacttgaccgaccgcttttttgtcatcctgaatcagcgcatccggctctgaacgcggcgtcagcgtgccgtcttcctgataggtgcggtccgcaaacacttcgcttgccgtcctcagtccgattcgatctcccgctttaatcagctcgcttccggaaagcccgaaaagaataagcccgggatcaaaatgacagaccgcctgagcgatggcttttgacaggccgggattgacggcggccatattatataaagcgccgtgcggcttcacatgctgcatctcgacaccttccgcttttaaaaaccctgacagcgcgccgatttgatacagcgtcagatcatacgcttcctcgggcgtaatcgcgatctgccgccgcccgaatccctgcagatcgaacagcccgggatgagcgccgattttcacgcctttttccgccgcaagcgcaaccgttttgcgcatcacgctgggatcacccgcatgaaagccgcaggcgatgtttgcagatgtcacataatccaaaatctcttcatccagtccgattttataagcaccgaaactctctcctaaatcacaattgatgtcaatctgaaacataagctccctcctgtattgtaaacgttttattttattatcattccgatatttggaacgactattccgaattgttggatttctcttcattatatttaattctgacaagtttgaacatccttttgtcagaaaacctaccatggacctagtcacaaatctgacaaaacaaaaaaagagagcctcatgctgagactctctcttttttctattataacacccagtggcggatcgctttggcgaccccgttttccgtgttgacatcagtcacccagtcagctgtttctttcacgatgtcctgcgcgttccccatggcgacgccgacacccgctttttcgatcatggcaatgtcattcagactgtcacccatggccatcacattttccatcgtgaagccgagtttttccgataccttcgccagcgcagccgctttgttgataccgagggcattgacttcgatgttgatcggacttgagtttgtgatttcgagctccttgtattccttgagctctttcagcacctcattccgcacttcatcatcctcgatttcgaacccgaacttgagccactgatgatccgtaatcgtttccgggaattcccctctccacactctatcgacggtagaggcccagaaattcgtgttgtgcttattcctcagatcccataatttttgaatatgatcggtatgaagaagcttgcgctcaaccagctcaaagttggaatcccagatttcgctgccgtttgccgtgattaaaaaggatgacagctcgagagactcagccagttcgcggcaggtcatcagcgtgcgtcctgtgctgatgacgacgtgaattcctttcgcctccgcttccttgatcgcccgccggttttcctccgggatgagctgctcgtcattgagcagggttccgtccatatcaatcgcgatcagtttaatatctgcgtcttctctttgtatcggcatatatgtacctcactttttatattgtagtcgtctctattttaatacatatgacccacaggaacaaaaaaccgcttcctgcgtttggcggggcgagcgttgaggaaaagaaatattgaggtgatggaggatgaaagaaagaaaacaaaagaacaaaccgaatgaaaatcctgaacatcatgatttaacggatccgattccgctggaagagctgaaggaaaacgccaatgacgaaaaacacaaacatgaccagagggacaattcacaaagtgagagagattatgatacaaaataacacgcttgtccgaaagccgccggtggaggcggctttttttacgatggctggataaatatgctgagctccgcttccgccacaggcttcccggcaacggacgctttcgcccggccgaacacaaaaccgcgtctgattcgcgtgacctcaaaaaaaagatccagacggtctcccggcaaagcggcacctaacctttccgctttcttcaccgcggataagagaccgagaccgtcaccgccggtaattcccgcgcaagccgccgtttgggccattgcttcaacgacgagcgaaaatggcatctctctttggtattcagttataaaccagtcattttcactgatgtttttgtaagcagccgcccattttccggcttcactgttcgtcgtgccgtcaatcaaaagaaacggaaaacgatggggcaatagcttctgattcatcacgcagcctcccttccctctcattataacgcaagaaaaaacccgcgtcccccgacgcgggttcatttttattgattgagctttttgagcacgatgccgtgcagcggttcatgcggctgaataccgcaaatgtcttgaagaacgccgctcgtgcctttttccgcgataagcttttgcagctcaaccgcttccggatcatcctgatagtcaaagcgcagggcggcggcgataccttccgccagcgcattcggttcttttatttttttggccggccctactaatctgtcattcgctccgagttttctgagcggtgatctggcgactcttgtcacatcatccgtgatgtattcattatcaaagcggctgatgattttttcatgtactgctcgtgttcggcttgcttaaagccgtacgctttcaccaagtactcgcccgtttctgaaagtgcatcgtacacgacacgccggatttccggatggccgatggcctctttgacggtttttaatccgcgctgatagccgacatacgccgtgacggcatgcccggtattgacggtaaacagctttctctcaatgaaaggcgtaagatcatccgtaaacaacgcgcctttaagtaccggctgatcgccggcaaagccggttctgtctatgacccattcaaaaaacggttctacggatactttcagcggatcttcatggtgctgaatcggcacgatccgatctaccgcagaatccgggaagccgactgtccggttcacgagttcccgctccgcttccgtcaaatgtccgaaaacttcttttttcagaaaactgctgccgccgatcatattttcacaggcaatgatattgagaggctcagaggacgttctgcgcttcagaccttccgcgatggacggggcgatgagtctgagaacgttcgggcccaccgccgtcgtaatgatcgccgcttcattgatcagcccgtacagctcttgttcttgcaccgcgctgttgatggctgaaacggggccgatgatttctgtctgcctgccgccgtcggcaagctccacggtatattccttcttttcattgagaaggctgaccatcgtttcattcacatcagcgaaaactacgtcatagccggaatgatggagcagggcgccgataaagccccgcccgatgtttcccgctccgaaatgaagggcaatcatgtcagttcacctcgctgaaaatagcggccagttcttcttccgtctttgcattgatcagccgttcgatgttttcttcctctgagcagatgatggcgatgtttgacaggatgtctaagtgttcattgttttttccggcgataccgaaaacgacctttgccgtattgccttcaccgtattccacaccattcggaatctggatgacggaaatgcctgaatgaagcacctcatccttcgcatcttctgttccgtgcgggatcgcaatgaaatttcccataaacgtggatgatgtttcttcacgttcgaacattttttccacatagccgttcttcacgtaaccgttatcaatcaacgtctgtcccgccaggcggatggcatcctcttttgagttcactgtctggttcagtttgatgttcgctttagccaatacttccatgatgaagatccctctttctgtttgattagtttttaagcttttcaatcagttcatcgtatttcgggctgtttaagaaattatcaaccgaaatgtgcaccgcctgcggcagcttcgctttcgcgcggtcagtcaggtccttatgcgtaatgacgatatccgcgtcattcggaagattattgatcgacgtatttgtcacatcaatatccaggtctgcttttttcactttgtttcttaaaatggaggcgcccattgcgctcgatcccatacccgcgtcacatgcgaagataatgcggctgacttggtcagcggaaatatcagcggcgctgttttccggctcttcctctttgtctgccaatgcggccgccgcttcacttttcctgcctttcatttcctgcattttttccgccgcggctgtcaaatcttcttcgcccgctttagacgatttcagaataagcgccgagacgataaacgatacggccgcagccacgatgacgcccgccagcacgccgagatagcttcctttcggcgtcagcgccaaaatggcgatgatgcttcccggagatgatgcggcgacaagacccgcgttaaagatcgagaatgtgagcagtccgctcgctcccccggcgatcgccgcgaggatcagcatcggtttcattaaaatgtaagggaaatagatttcatgaatcccccgaagaaatgaatgatcgccgctcccggagctgtcgatcttgaagagcctttcccaaagaacatataggccagtaaaataccgagtcccggtccggggttcgcttccactaagaacagaatggattttcccgctttggcggcctgctcgattccgatcggacttaaaatgccgtggttgatcgcgttattcaggaacaggactttcgccggctctacgaaaacgcttgcaatcggcagcaaattcgcgtgaacaatgacttccacacccgccgccagcaatttgttaagagacaggacgaccgggccgatcgcataaaacgcgataatcgtcagcaccgcgccgataattcccgccgtgaagttgttgatcagcatttcaaaaccctgtctgactttatctttaaacagacggtctaattgtttaatgagataaccacccaaaggtcccataatcattgcccctaagaacatcggaatgtccgctccgacaatgactccgatggcggccgtcgctccgacgactcccccgcggtgatcatagatcatttttccgcccgtatatgcgattaaaagcggcagaagatacgtaatcatcgggcttaccaatgtattcagctgcggattcggaaaccaccccttaggtataaacagcgcggtgataattccccatgcgataaatgcgccgatattcggcatgatcataccgcttaaataactgccgaaccgctgtatcttcactttcatgccagcttgctgttcttgctgcatgttcattccctccctgtttgcctgccttcagatgaaaataaataagacacggggtttctctctcccctgtgtcttcatcataaaacgcttacaatccccattcaatgaaaagtaaagaggagtttggcacagagactgtgacaaatccttaacaaaaaaaagacacctcatcaaaggtgtcttaccgctttctgtatataatgtgtccttttgtgacgacgagcttggcaatgagccgctcactgacaataaacaccggatacgcacatacgagcgcgaaaatggcggccggcacataccgcgctgccggaaacatcggcatgacggcggttctggccatctgcacaagataaatcaaaagcaccgtgatcgcaatggccgcagccataatcggagctgatactttatattcacgcaatttcacatggcaatgcccgcactgaaactggcacgggatcatcgatgatctgaccatgtcgcctgtaatcggcttgccgcagttcgggcaggtcgtttctttcatgtttattcctccattcaactcttctattataacagagtctgactgcgtgttttacatttgtgattgttcaacattttttcacatattttatcatcaggctcttgtgtgcatttgtgaaaacatctactcttagagggaggttcatcactcattcgcataaaaaggaggatgcagaattgcttccgattcacagacagcaaaccttgcttgaatggctgaaagaagagggcgcgctgaaaatctctgacataagcgagagattcggcgtctccgagatgaccgtgtacagagacgtcaatcagctggcggatgcaaaccggattatccggacacccggcggcattacgctccctcccgcttcagaacgaagcgccaatcaatgcggctattgcctgcggccgattcagcattcgtattctgttcagcttattaccgtttcacaaaccgttgagcagatgtgctgcattcattgcgcgattttgcggtatgaggataaaaaggatgaagtgtcccacgtcatttgtaaggattttcttcttcagacgacgctaacggcagcttccgcatactttttagtccatgccgatattgaccttcactgctgccggcctcaggcgattcccttctcaacgcttgattacgcagaacggtttcaaaaaggattcggcggggtcatttgcacctttgacgaggcggcggacatcatcttacacgacaggcagaagggatgcacctgcagcaagacataacaacaaccaaccggaaggcggtgtcatcatccatgagacagaacaaacgctggctcgtctttttgctgttccttgttttgattccgaaaacaagcttcgcccacgcctacatcacaaactcaaatccgggtgagaacagcgaattaaaacaagcgccgaagcagattgaaattgagtttaatgaacagattgaagaaggcttccactccattaaggtctataattcatccggtgaacgggttgacgcgggcaaaacggtgattcaaaaaaataatgcccgcatcatgaccgcggcattgaaaaaaaatctgccgcatgatatttacagagcggaatggaacgcggtatcggccgacggacatccggtatccggcgtcatccctttcagcatcggaaaagccggcggagaacttcaggagcagacatcatcgcaagcggcgcttcatcccgaagcggccatcgaccgcggtattttgtacaccgctctctccctgtttatcggcacggcttttttccatctgttttggtacagaaataatgaagattcatcaaaagcaaaacgaactgtaaagctgctcgtgatttctttatgtttaacggggctcgcgctcgtgtgccagctcccgatccagacgaaagaaaacgcgggcggcgcttggagcgccgcgtttcagccggactatgtaaaagaaacgcttctgaaaacggcaggcgggtacgtctggatgatccagatcagcttatttatcctgctcgccctgtccatgatcccgctgctgaagaagaaagcattccggtcatttgcgtactggacggcgccgctgttattcttcttcgcttcgcttttggcaaaagcattcgccgggcatgcggccgttatcgacgaaaaagcggtcggcatcgcaatggactttctccatttatcggccgcgtctgtatggatgggcggtatcgccgcgcttgtgctgcttctttcatcagagtggagagaacccgataaaaccatcgcttgggaaacggtcagacggttttctccttgggcgttcgcctctgtcggcgtgctgttattttcaggagtgctgaatggatttttcattatccgctcgttcgattcactctttcacaccgcttacggcaagacgctccttttgaaaatcggactgtttgtcatcatgcttgcgctcggcgccgttcacgtatggatgacgaagttcagcagaaaaaggagcatcagcgcaacgataaaggccgaatgggcactaggcattgcggtgttattcacaaccgccgtcttcacaagcctgcccagtccgcctccgcccgcgccattgccttttaacggctcagaaacgatcggaaacggggaaaccctatccttgcacattacgccgaaccagccgggtaaaaatgaatttcaagtcattgtcaccgatcataacggcagcttagtaaaagacattcagcaatttacggtcactgtttaccagacgggcttcagcggcaaacagcatgaaagcacctttgatttgaagaagacgaaggaaggcacattcgaagccgccaacctgtccatcaccgaaaagggaaactggaagatcaaagtccacggactgacaaacgattttaatgaaatcaaccaaatattctcaacgacaaactaaggagtgtatctcatgttgaaaaaaaaagctttaatattcatatccgccgtgaccctgtcactcgtcggttttacggctgcagcaagcgcccacgtctcagtcaaacccgcggaatccgcggccggttcttgggaaacgtacacgatgaaagtgcctgtggaaaagaatgagccgacaacgaaagtcgtgctgaaaatgcccgccggcgttgaatttcagcagtatcagccgattccgggctggaaaacatccgtatccaaacatgatgacaaagcggtctccgtcacttgggaagcaaaggacggcggcattcagcccggccaattccagcagttcacgttcgttgcgaaaaatcctgaaaagagcggagatgccgcttgggacgcttaccaatattacaaagacggcagcattgtagaatggacgggtgatgagaaagccgacacgcctcactcgattacgaaaataacgaaatcggcgagcgtgacggatgcgcacggagctgaacagtcaaacgaagaaagcaaatccggcgtatcagcgcttgatattgcggccatcgttctgtcagctgcggcaattatcctttccatcgcggcgcttgtaaagaaaaaacgtgtgtaagcaaaaagcgatccggctctaaagagcctgcgatcgctttttttcttatccgcggcctgcctggaaagacggatatttggtcattcccccgtcagcaaacagcgtaatcccggtcacatagcttgattcctttgaagcaagccagacggcgacagccgcgatttcttccggctcaccgatatatcccatcggaatcatgctttccacatcttttttctgaacgggatcggcaaatttttccgcgttgatcggcgtattgatggcgcccggcccgatgttgttgacacggatgcgcttcggcgcgtactcaagcgccagcgtttccgtcatcaatttgatgccgcctttactcgccgcgtagtggacaaacagcggccacggaatcatctcatgtacgcttgacatgttaatgacgtttccttgaatatcattctctacgtaatatttaatggcttcgcggcttcctaagaaagcgccggtcagattggtattgataactttgttccagtctttaagcggcatttcatgcgactgaaccggattttccatgccggcgttattgatcatgacatccaatgtgccgaattccttcactgcggtctgcacgatgtttttgacatcttcttcttttgtgacgtctccttgaacgatgaccgcttcgcctcccgctttttgaatctcttctttaacggtttgggcgtctttttcattactatagtagttaaccacgactttcgcctgctcctgtccgaagcggatcgccatcgcttttcctaatcctgatgaagctcccgtaatggcaacgacttttccttttaaatccgtgtacatgttcaaacctcctgcatatgttatgaatttgatttcgcaacgcctaagaataccgcggctacaatgatcaggataatcccgatggcaatggcgaccagctgacgcttcgttttgctctcacggagaatgaagattccgccgagcgtgctgatgacgatccccatttgagagagggaaaaacttgtcgcaactccgacgcgcggctgtgagatgaacagaaacatgttcccgagcgcccagatgattcccggcagaatgttcttgagggcgtacttattaaacggtttatgcttgtacgtcaggagcagtccgccgatgaccatcccgatcgcctgcggcagaagcgctgaccatccggatacaccgaacagccgggcgacgacgacatagaccaaatagccgagcgtggagatcagcaggatgacaatgcctttttttaagtttcccggttctccgtccgcccgcccctttttatcttctaaagatgtgagcacaatcccgatgatgataaaaataagggcgagaatacccagcgtaatcgcgatcggggttgaccattctttgaatacgatcacaccgaacaaagaagtcgagacgagctgcattcccgttgatatcggcatcgtttttgaaacgcccatcagctgtatgcttttaagctgattgctttggccgagcgaccaaaacagccccgagatgatgccgacaataaaaatgcgcccggacagcaccggatggacaaacagatacagcacaaacgaaacgatgagcgccccgattgtcgttcccagcgtctggctgtaaggcccgccgcctaatttgacgttaaataacacgatgctcccccaaaataaagccgggagaagagccagtaatatatccatgatggcgaccttctttcaatcgtatttgctgttattttgtctggaatcgaaccgattattcccgcaagatcaaaaaagcctgccggcgatattcaccggcagaccgctcaataaaaaagccccgcttagaagcggggctttcttttcggctcattaaagtccgatagacatgtatttggtttccaggtacggttcaatgccttccgtaccgccttcacggccgatgccgctttctttcattcctccgaacggcgcttgaaccgcggacggaccgccgtcattccagccgatgataccgtattcaagctgttcagaaatatagatgccgcggcggtagttttctgtgaagaaataagccgcaagcccgaacggcgtatcgttcgcaagcttgatcgcttcatcaatatctgagaacgtaacgatcggcgcaaccgggccgaatgtttcttcatgcatgatgttcatggatgtatctacatttgaaagcacggtcggcgtcacgaaatagcatcctttttcgtcgttttggtcatacgttccgcccgtcagcacttctgcacctttttccacggcgtcattaatttgcccgacgattttatcgaagccttttttgttgatgacagggccgacgtttacgcctttttcaagaccgtttccgactttgagtttcgcagcttcttcactcagttttttcgcaaactcgtctttcacggattcgtgtacgatcagccggttcgcacagacgcaggtttggccggcatttctgaatttagaggccattgtttgggctaccgccagatcaagatcagcgtcttcatccacgatcagcggcgcatgtccgccaagctccattgacatatgttttacggtgtcggcgctgtttttcatcaggattttgccgacaggcgttgagccggtaaaggtaattttacggattttcgggctgctggtgaagacgtttccgatttcggctccgtcaccgatcaccacttgcagcacgtccttcggaattcccgcttcatatgcgagacgcgcaagggcgtaagcggaaagcggcgtatcctccgccggtttgatgatgaacgtacagcctgccgccaaagcgggcgcggcttttcttgtaatcatcgcattcgggaaattccacggcgtgatcgcggctaccgggccgaccgcctgacgggtgacgacaatccgtttgcccgttgtcggcgcaggtacggttctgccgtaaatccgttttgcttcttcggcgaaccattcaatatagccggcgccgtataaaacttctccgaccgcttcttcgtacggtttgccgttttctttcgtaattaattccgcaagttcttctttattttcaacaatcagctcataccattttctcaaaagtgaggcacgttctcccgctgatgttttggaccatgattgaaacgcttgatgtgaacgttcaatcgctttttcaacatcttcggccgtctgctgggggatgctttcgatcgcctctcccgttgccgggttgtacactgttaattgttctggcatattgaacattcctttctttcctatagtaaaaccattgaatgcttgttgatgtatctcacactttcatgatagcagacacatccggcgggattccaataattgaactcacagagctgcttcgataatggaaaggccttctttgagctgctcatccgtcacgacaagcggcgtcaggaatcggataatgttgccgttaatgccggccgtcagcagcagcagtccgttctcgttcgccgttttagcgatcgccgcggcttttgctttgtccggttcccgcgtgtacggatctttgacaatttcgatggccgccatcgcgccgagtctgcgcacttctccgatgcaggcatgctcttttttccactcgatcgcttgatgctcgatgatccggccgatctcttcggaacgctgattcagcccttcttcttcaataatatccaagaccgcgagcgcagccgcacagccgagcgggcttcccgcatatgtgccaccgagttcccccggcgcggcggcatcaagcatttccgcccggccgatgacaccgctcagaggcaatccggccgcaagtgatttggatacggtgatcaaatccggaacggcttcgaaatgctcaatcgcaaaatacgttcccgttctggcaaaaccggtctgaatctcatccgctacaaaaacgataccgtgttttttacaaaaagcggcgacgtgctgcacgaaacgttttgaaggaatgatgaagccgccttctccctgaaccggctccattacgacacaggcgacggtttccggtgcgactgcggcgataaagaaatcctcaaaagcgctgatgataaagtcgtcatactgctcgtcgctcatgccggccggcttttgataatagtaaggaaacggcgcttgatacacctctgaggcaaacgggccgaaaccgtatttataaggcttcaccttgctcgtcatgctcatcgtcatgttcgtgcggccgtggaaccctcttgtaaatgacacgacagcctggcgcttcgtatattttctggcgattttcacggcgttttccaccgcttccgcccccgaattgagaaaaatcgcttttttcgcatgatctcccggcgcaagggcgcaaagtttttcggccagctcaatataagacggatacatcatgacgttaaatcccgggtgaatcagatcctccgcctgtttcttcacggcctccaccactttcggatgagaatggccgacattcagcgttccgatcgctccggcaaaatcaatgaatcgtctgccgtccaaatcgtacaaaagcgccccttccccttttaccgccatgctgcggtttccgttgccgacccccttggaaacgaattggtcccgtttttgctgccactgggcagttgtcacttccgatgatgctgttcgactcatagattccatccccctatattgttttcttatcattctgacttctttttggtatgatgaaaagtaccaaaatcaatttatccatggtatcagaaaggagcagggtctggatgctgacgatttccattaatcattcggaaacggcggattatatctatcagcagatctatcagcacataaaagcggccgttttgaaacgcagcctgatgcctcatacaaaggtgccgtctaaacgggagcttgccgagacgctgaaggtcagcgtgaattcagtgaattcagcttatcagcagctgctttcggaaggttatttatatgcagtcgaaagaaaaggctttttcgtggaggaaattgatacggtttatcatgaagaaacgccttcgctctcattgcctgaagatttaaaagagcgggagccggataagagcggctggatttcgttttctcatatgagcgtggatacggcgcattttcccctgaaaagctggttccgctgtgagcataaagcagccgcccgttcatttcatacactcggggaactcgtccatccgcaaggcttatatgaagtccgtgaaaccatttcgcggcttatttccctgacaaggggcgttacatgccgcccggaacaaatcgtgctcggggcgggcacgcaaatgctgacgcagctgctgacggaactgctgccaaaagacgcgctgtacgccatggagaacccgggatatatgaggatgtaccggctgctgcaaaacctcgggaaaaaggttgcgacgatcagccttgatgaaaaaggcatgtccatggccgaaatcgaaaaacgccggccctgtgtattgatcaccacgccttcccatcaattcccctcaggcgtgatcatgcccgcttcccggcggattcagcttttaaactgggccgccgaacagaacggccgcttcatcattgaagatgattatgacagtgaatttaaatatgacgccgatacgataccggcgcttcaaagccttgaccggtttcaaaatgtcatctacatggggaccttttcaaaatcccttttcccaggtctgcgcatcagctatatggttctgccgcccgggcttttgcggacgttcaaagagagagcgtatgacctgcatacgtgcagcacgcttgcccagctcgcgctgaaagaatttatcgactcaggtgaatatcagaaacatattaaaaagatgaagcagcattataagaacatgcgggaacgcctcatttcggctttagaagaaatattcggagaaagaatcagtgtaaagggcgccaatgcggggcttcattttgtcactgagtttgactgcgcccgttcagaaaaagagattttggcacgggcggatgcagaacagctcgatctgtttgcgatgagccggttccgtctgaaagcaggaggcgattcaaataagccgcagctcattctggggttcgcccgcctgaaggagagcgatattcaagatggcgtcctcaggctttaccgggcggttttcgacgcataaaaaaacccccggaattcggggacttatttaccagcggtccggttctgtctgcaaaatcgcctccagcaggccgggaaacgccgcttgtaaatcatctttgcgcagggaataataacggtgcttcccgtctatgcgcacttgggcgatccccgcttcccgcagcactttgaagtgatgggacagcgttgatttggcgacccggacatcagcgcaggtaccgcacgttttttctgttgtttccgccaattgtttgaccagctctaagcggagcggatcactcagagcatgaagaacctttgtcagctgtaagcggtcggtttcaggatggtttggaatgttcatgagtcaaatgtaacacataaaagcggcgggtgacaatttaggcggtgagggtttttcctttaccattcactgcgaaacatgttacagttagttcgataatattcgaactataacaaataaacccaatcaggaggaataacaatgatcgtcttacaggcttacatgaaagtaaaagcggataaacgcgaggaatttttaggagaagcacaatcacttgttcagcattcacgcgcggaagaaggaaatgtgcaatacgatcttttcgaaaaagtcggtgaggaaaatacattcgttatgcttgagcaatggaaagatgaagaagcgatgaaattccacaacgcaactgaccatttccaaggattcgtggcaaaagcaaaagaagtgctgagtgcgccgcttgacgtcgtccgcacagaactgtcagagtaacgaaaggatgaatgacatgaacgaagtccttcaaatattaacagaccaccgttccattcgcagctacacagatgaacccgtatcggatgagcagctggaccttatcatccaagcaactcaggcagcgccgacttccattaacggccagcaatttaccgttattgcggtgaaagataaggagcggaagaaaaaaatatccgaattggccggcggccagccgtggattgaccaagcgcctgttttccttttattctgcgctgattttaaccgcgccaaaattgcgcttgaagaatataatgatacaccgcttgagatcacgaacggtttagagtccgttctagtcggagccgtagatgtcgggattgcgctgggtacggcaacggctgcggctgaatcaatgggactcggcactgtgccgatcggcgccgtgcgcggcaagcctgacgaaatcattgaattgctgaaacttccgaaatacgttttcccgatttccggtctcgtcatcggccatccggcagaccgctccgcgaaaaaaccgcgtctgccgcaagcagccgttctgcatcatgaaacgtatcaagaagaagatttaagaacccatatcgaggcctatgacaagcagatgtccgaatacatgaaaaaacgcaccgacggacaggaaacaagaaactggtcacaaggcatcacttcctactataagcaggtttattatcctcacattcgtgaaatgcttgaaaaacaaggatttaagacggataaataaacgtatcagcctgtcggaacactccggcaggttttttctatttctcaaacaaaagcgttgacactatgtaaaaatttttgttaatattttcatcatatactcattggttttctgtgaaccgatgggttttctattgtgacgaaagaaggaatctgggcttatgaatgataagaaaacggatattctgctggcggcaaggaagcttttttccgggaaaagcttttcgtcggtctcgatgcaggcgatcgcagaggagtgcaaagtctccaaagcatctttgtataagctgtttgaatcaaaggaagacctgctcctggagctgctcgattttaaccagaaacagatggtagcggccgcttcattattaaatgaagaaacgagcctctcccctgaggaacggtttgccaaaaaactgatggctgagcttgaaggcttcaggcgcaaccagcagttttttaatatgctgatgtacggaagcccctcttccattaatgagcgggtaaaacggcatattcacagggcccgctccacctttatctgctggcatcgcgattcactgattcagacgtacggcgaagacattattccttatgtatgggagctggtgatcgtcctgcaggggctcctgagagaatgcatcacgctgattaagctggaaaaagaaccgctcgccctggagccgctcacggactttatcatccgccatctcaatctcatcgtcgaaaacaggaaaaccgaaacggctttgcctcaggagatgattgacctttataccgcctccgcttcctcatttgagccaaaagacaaaaccgtattgctggctgaaagcctgaaggaactgaaagaagccgtctcagcccttccggaggaaaaatatgatgccgcaggactcgcttccgcggcggttatgctggagaaagaatcagcggacaaacagccgcgggattttcttataaaagcgctcatcggttatttggagcaggccggaccgctgcaccagccgcttgcagccgttaaaacattgctcaaactataaagaaagaaggaatcagcttgaataagagtattaaaactgcaccatacaaccgctctgtcattgtcgggattcttttggcgggagcgttcgtcgccattttgaaccagacactgcttatcacggcgctgccgcacattatgaatgacttcaatatagatgccaacaaagcgcaatggctgacaacgtcgtttatgctgacaaacgggattttgattccgattaccgcatttttaatagagaaatttacgagccgcaccctcctgatttccgctatgagtattttcacggtgggcaccattgtcggcgcattcgccccgaactttccggtgctcttaacggcccggattattcaggcggccggcgccggaattatgctgccgctcatgcagacggtatttctcacgattttcccgatggaaaagcgcggccgcgccatgggtatggtcggcttggttatttcgttcgcgccggcgatcggcccgacgctttccggatgggcggtcgaagcattctcttggcggtctttgttttatatcatcttcccgatcgcagtcatcgatttgcttttagcgattattctgatgaaaaacgtcacgacattacgagaaacacagattgatattttatccgtgatcttatcgaccctcggattcggcgggctgctttacggcttctcaagcgccggttcctcaggatggaccagtactgaagtgctgacttcgctgcttgtcggagcggccgcgctgattttctttatcgcaagacagatgaagctcaaaaaaccgatgctggaattccgtgtgttttctttcgggattttcagcctgaccaccctgctcggaacgcttgttttcgcgctgctgatcggaacggaaaccattctcccgctttacacgcaaaaagtccggggcgtctccgcgtttgataccggattaatgcttttgccgggcgcgattgtgatggggatgatgtctccgtttatcggccgggtgtttgacagaatcggcggaaaaggccttgcgatgaccggattcttcatcatcctgctcacgtccctgccgtttatgaatctgacggactcgacgtctctcatttggattgtcgtcgtttataccgcacggcttttgggaacagccatgattatgatgccggtgacgacagcgggaatcaacgccctgccgcgccacttaattccgcacggcacagccatgaacaataccgtccgccaagtcggcggttctatcggtacggcgctgctggtttccgtgatgagcagccaggccgcgcacgccaatgcgtcaactccggcaaacgccgccctgcacggcatgaatgcggcctttgtcgtagccgcctgcatcgcgctggccggcttcctcctatcttttacattgaagaaaaaaccgcgtcagcccgagcagcagcaggccgttacgcggtaaaccaaaaagaacccgatcacgtatgtgaccgggttctttttttacttctcgattccgtcttttacttctttcaccatttgcgccatggattccaggccgcctcctgataaataccatgtagctgaatcaaggtagacaacatggttgtttttcacggctttcaccgattttacataatcattttcaaccacttgttttgttgaagattttgtgccgatcgctgttccgcggtcaacgacaaacatgtaatcagggtttgttttggcgatatattcataggaaatgctttgtccgtgcagtgaggcttcgatgtttttgtcagccggtttgacgccgaacacatcatgaatgaagccgtatcttgatttagacccgaacgcgctgattttgccgtcgttcgccatcaccactaatccgtttttatccgtgctgcttgtctttttcttcagatcggcaatggatttgtcaattttcgcaagcttatctttcacttcattttctttgttaaagattttgccgatcacttcggtgttttgcttgaatctgtcaacgtagtttgtatagtcatcatcaagataaatcgtcggcgcgatttttgagaactctttataagaatcagattgtctgtgggcgataatgattaaatccggatcaatatccgcgactttttcaaaatccggttcttttaaaccgccggtattggcgtatttatcactattatatgaagataagtattttggaaggttttgtttcggaagtcccgccacgtgatcctgtaaaccgagttcatccatcgtatccagcattccgaagttgaatacgacgacttttttcggattcttcggcactttgactccttctttgttcagatcatctttgattgtgattgtttcttttgatttgcctgatgttttgtccccgtttccgcatgcagaaacaacaaaaatcgtaactagcgcaatgaatagcaatgcgaattttttcatgactttcacctcatctggtttttaagaaaagtacacaccgatccgctgactgtcaatctcttgaatcgggatggtcatatcataaatatcttcaagcacggaggtttcaatgatctcttccgccggcccttctttgacgatccgtccgtttttcagtgcgacgatatggtctgaatatacggatgcgaagttgatatcgtgaatcactacgacgaccgtttttccgaagtcttccacaagccgcttcaacagcttcatcatttcaacggaatgcttcatatctaaattgttcagcggctcatcgagaaaaatatagtccgtatcctgagcgatgatcatcgcgataaacgccctctgacactggcctccgctgagctgatcgaggtatttatcctttaagtcatccagcttcatataactgagggcctggttgatatgcacccaatcttcatccgtcagtttcccttgggaatacggaaatctgccgaagctgaccaggtctttaatcgtcagtctgatattgatttggttcgtctgcttcaggatgctgatttttttcgccagatcgttgcttttacaggccccgatctcttgcccgtcgaccgtgatttctccggaatccgtcttaatcagccggctcatgatagacagcagcgtgctttttcccgcgccgttcggaccgataaacgaggtgagcctgcccttttgaatggatagagacgttttctcaaggacggttttccctccgtattgtttgcttacatttttgacctctaccatgatttattctcctttaacagcagatagataaaataaatcccgccggcaaaattaatgatgacgctcagcgtcgtggaaaacgtgaacactttctccacgacgaactggcccccgacgagcgcgacgatgctgatcaggacggaacccgcgattaaatacgtgtgcctgtaggtttttaaaaactctctcgccagattgacgacaagcagtcctaaaaacataatcggcccgacaagagccgtagagacagacacaagaatggcgacgacgatgagcatctgtttcacaagcttatcgtaatcaatcccaaggttgacggcgtgctccctgccgagcgacagcacgtcaaaaaaccgcgtgaaccgccagacataaatgcctgtcagaagaaagacagcaccggcaaatcctaaaagatcggtgttgatattgttaaagctggcaaacattttgtcctgaacaacctggaactcattcggatcaatcagcatctgcataaaggatgacagactgttgaacagcgtgccgaacacgacaccgacaagcagaaggaaaaacacgttccgcccctcgcctttaaacatgagctgatacaaaacgagtgacaagagcaccatcagcccgacggagatgacgaaattaagatttttgttcatcatgacgatattcattgaaccgaacaggaacacgatgacggtctgaatgagcatatacagggaatcgaggcctaaaatgcccggtgtcagtatgcggttatttgtaatcgtctggaagatgaccgttgaaaacgcgatcgctccccctgtgagcatcatggcaagcactttgaagcatcgtctcggcagggagtattcccaattgcccagtccgtagaacagaaagaatccgatacatattatggcgagcgccgccagcagcgtaatttttttattatgactcatatgcttttctccttaacagcatatacaggaagatgccgctgccgataacaccgaccatcaggccgatggaaatttcgtacgggaagatgatcacccttcccaaaatgtcgcaaaacagcacaaaaacagcgcccaagagagcggtgtgaggcaggctgctcctcaggttgtcccctttgtaaatcgacaccatattgggaatgatcaaaccgagaaacggcagcatcccgacggtcaggatcaccagtgaagcgatgagcgacacgataatcagaccgatattgacgacgcgtttgtatttcaggccgagattgacggaaaagctctctcccattcccgccaccgtaaatttatccgcatacacataagcgatgatcaccagcgggatactcagatataaaagctcataccggcctttaacgaccagtgagaaatctccctgcagccaagatgacaggttttggatcaggtcgtatttatatgcgataaacgtggcgattgagctgacgatgttcccaagcattaaaccgacgagaggaataaaaatcgcatcattgaacttgattctctcgaggattttcatgaaaaggaaatttcccgccaacgcgaaaataaaagcgatagacattttcacaagcgggctcgctgacgtaaaaagcattaatgaaatcaaaattccgagccttgcccagtccatcgttcccgcagtcgtcggcgatacaaatttattccggctgatctgctgcatgattaatccgcagatgctcaggctcatgccggcgatgataatgctcaccaaacgcggcagccggctgtcaaacaatgtacctgcctgttctttatttaaatgaaaaatatccagcggcgacaaatcttctacaccgataaatatagaagtacacgccaaaaccgccagtagcaaaagtaagtaacgtagcttcatgctgcctccctgcacccatcacaaacggtatgactgattgccaaacaactcccatatatccccactcgtaatgattatcattatcaacgacaactataatcttatcatctttccaagcgcagtcaatacagttttgctttcaaaaacggtcatccgcgggccgtacactaaattgtcttacaatcagtctatcaagaatttgcaggattttctataaccttcatttggctgcttatcattttttgcacatgatgacacgcttgcgggaaacaaatctgacaaacagcggcaaaattcctccacgaaaatacaaatgttctccccacatagaaaaaatccttgatttacatgtttgaaagagagataataaaaattaaatttgtgagaaaatttaaatattaggggatgtaaatcatgaaagttgtaaaattcggaggcagctctcttgcgtcaggagcccagcttgagaaagtgtttcaaatcgtgacggctgatccctcgcggaaagccgtcgtcgtatcggcgccgggaaaacgcttctcggacgatacaaaggtgacggatctgttaatccgctgtgcggagcattatttgcaaaatggtgcagcgcccgagcttgccgaaccggtcattgaacggtacgccgccatcgcgcgtgagctgaacctggatttctctattatagaaagaatccgcagtgacctattcgctctcttaaacagcagcaaagccaatcccgatcagtatatggatgcggtgaaagcgagcggcgaggacaacaacgcgaagctgatcgcggcctacttccgccggcagggcgtgaaagccgaatacgtaagcccgaaagaagcggggctgtttgtgacgaatgaacccggaagcgctcaggtgctccctgagtcttatgatcatttgtaccgtctgagaaaccgtgaaggcttgatcatttttccgggatttttcggttacacgaaggagcatgagattgtgacgttttcccggagcggttctgatattaccggctccattctcgccagcggcttaaaagccgacctgtacgaaaactttactgatgtggacgccgtctattccgtcaacccgtcaatcgtgcggcatccgaaagagattaacgaactgacgtatcgggaaatgcgtgagctctcctatgccgggttttccgtttttcatgatgaagcgctgattcccgcttttcgggccggcatccccgttcagattaagaatacgaataatccggaggcgaaaggaacgcgcgtcgtcagcagccgtgacaatacgaacgggccagtcatcggcatcgcaagcgacacgggcttttgcagcatttacataagcaaatatttaatgaaccgggaaatcggtttcggccgcaaagcccttcacattttggaggaagaaggattgacgtatgaacatgttccatccggcattgacgacatcacgatcatccttcggcacgatcagatggactcagaactggaacacaggctcgtcacccgtctgaagcaggaacttcaagcagatgaagtcacagtcaggcacaatctggcgctgattatggtcgtcggggaagcgatgcgccataatgtcggcacaaccgccagggcatccaaagcactgtccgaagccggcgtcaacatcgagatgatcaatcaggggtcatcggaagtcagcatgatgttcggggtgaaagaagaacaggaaaaacaagcggtgcgggcgctgtatgacgagtttttcgccggagtcttactcccataggacaccgcctcttttttctcttgtccactaatatcccttacaaagcagcttcttttacatattgtatggtatagacaatatggaggtgaagctcatgtcaggatattctggaatcagctctttcgctttgatcgttgttttatttatcctgttggttattgtaggtactgcctatgttggcggtttctaagcatcactccgtctatatgaggacgctgcgggttttgacctgcggcgttttcttttgttttccgccgctgtccaagtccggccgcgcaaaaaaaagactgccgggaacattcccgggcagtcttttcctttgttcaggttattttcttctcacgtcattcctctttcagctacatggaattcagcctgatctgtctggcctgcacctgtcactgtaaaaatcgcggcggctgctaaacaaataacaaaccatttagatttcaatttcatacaaaccctcactcctttgtatttgtttccttgcctcttcgactttcagaaaatagtcagaagaaatcttaaagcaattttgttcatagtaatatttagctgcttctagtgctaaatcctctatatcggcgtataaatttttatcttccaggtaacggaaacacgcgctgattgtttcctcatccggtttcgcctgatacagagcctgcagccattcgaattttaccgtgtaaacgggatcgtctgtttctttagcatattcatatccccgcttgtgatattccgacgctttttctttttttccgagtttaaagtaaatgagtgtgattaggaaatatgcttgaggaagagaattgacgattctttgtgattcaaatgtatcaaccgcccgttcaaagtacggaatcgcttcgccgatgcggtcctgattgtagtagcacagtccgaggttatacagcgccctcccgacaagctgcgctttttgttctttttcggccatttgcaaagcgtgctgaaaatgtttggccgcctgttcaaagcgcctttcatccattaaattgacgccgaatacaaaatggcattgaatgatcctgacgttatatgtgtcctgctctacgtaaatttcataagcgttttttatatgtatcaaagaaaaatacgtttgtttcatatgataataagcttcggccactttaaaataaaactccgcccgttccacgtggtccgatacgaaggccagttttttctcagcttgtttataatacgtaatcgctgagataaattctcttttatcaaattcaaacatgcctttgaaaaagttgacgtaataatcgagaagccctttgaggccggcctggctgttatcaatgttatcaagaatttccgacagggtcggctggtcttctatcttcagtttttccagcggctccaagtagtccagcatcagctgatggcgaaattccatgagggaataataaagcactaagtttgaatcaggctccatacggtcaagctcttgtttgatctcggccttcaagatctccgcatccggcacgctgaatgttctgatgtatcgataccactcgttaattttctgcccgactgctgaagaaggaattaacccgctcttcattccttcaccctccccatccaagacctgtttaccagttattttatcacgtttccgtgtctttccatcccgaaaaacacgcaaactttgtttcggcagagcgcaattttccgagtgaagataaaacagccggtagccagacgggactgccggtttcaagatgattcatgtatcgtattcagcggaaggcggattgtaaacgtcgtgccttttcctttttcgctggcaatatctatcgtgcccttgtgcatttcaacgagctgcctgacgatggacaggccgagtccgtattcgccgtatgccgtattcgtccgggacacgtccgccttataaaaccgctcccatatatgctcaatttcctctttggagatgccgattccggtgtcttcgatctcaatcaccgtttctttatagccttcatacccgcgcagcgtgatgtctccgttttgcgtaaattgaatgctgtttttcgtgatgttgacgagaatctggatcagcctgtcataatcggcgaacactttgacgccgtcctccgcctgaatccgcagctgattttgtttttcctccgcctgctgattgagatgctctttaataatttcaaacacctcgatgagcggcagactgagcttgtccagtttgatttgctgggatctgattttttcataatccagattttctttcacgagcctgagcatccgcttcgtttcttcactgatcagcgagaagcatttctctttatctttttccgggatggtgttgctgttaagcccctccacaagtccgttaatggtcgtcaaaggcgttctcagctcatgggagacatcggcgataaattggcgcctccgtttttccaggcggtcaatctgctctctcgattgcttcagatttttggccatgatgttgaaatcggacgccagcatgccgatttcatcgccgccgctgttcttgagcgaaatatcgtaatccccggatgccacttttccggtcgcatcccgcaatgtctgaatccgcttaacgtgaaatttagataaaagccagctcagcagaatcgtgatgataagggtgctgataatcgcgtaaatcatatagcggttgacctggctgatcatctgctcgacccctctgacgggagacacgagcagcaccgcgcctttaaattgatcgttgatcaaaagcggttttgcgacaagcgatacttccaagccctccgtattaaaacggttcatctccgctctgatctgaacggttttcccttgcttcagcatgtgccactctttacttttgagcttctcgcgcggcggcatatcgtcaggaaaaaagtaaggccgctgatgttcatcaaaaataataaacctggtctcgcgcgtttttaacatgtcctgatacggatacaggcggcgcagatcaagatcgcgtccgttcagctcacttgtgatctgctgggcgtaagaagacagctcatccactttattttgatacgcaaaatctttcacaaagtgcgaaaacagggaaatgataatgaaaaaggccaaaatcaaaatgctgacatggcttaacagcagctgatataagtatttaatcctcatcaaatttgtatcctacccccacaccgtgtataaaaacggtttttcctcactggacagttttttgcgcagccgtttaatatgaacatcaaccgtacgttcatcgccgtaaaattgatagccccacacctgctcaagcagctgctctctcgaaaagacctggcgcggattttgtgcgagataaaagagcagatcgaattccttcggcgtcagattctcgacaggctttccatgcagaaacacttcccgcgtcttcttattgattgaaaaacacgccgtttcgatcaagtcgccgctttttacggcctgccccgtcgcccggtatcttctgatcaccgctttaatccgcgctactagcgtcagcgggctgaacggcttggtgacatagtcgtcggctcccatttcaaacccgatcacctgatcagactccgtgtcctttgcggtcagcataataatcggcacactgctcgtctctcttattttccggcagatcgtcactccgtccatagatggaagcataatatccagaatgaccaaatcccagtcctcttccgtgaaccgctgatagccttccactccgtcatggacaaattcggcttcaaatccttctttaaaaaagaacatttccgtcatggtgcatacgcttatattgtcttctatcattaatatcttcattgggtcctccgtttatcttgacgcttttacttataatagcaccattttacccggatattttcgcgtttcacaattgttagtttttatttcatcacccggaaatagtttgttcatatttttttcatacatttctcctactatatacatatcggataaccggttctaaagaaggctggttttacaagatctgacacccacacggaggaacagacatgaactttataaaaagagccttttggagcatgaaggcaaaaaagggaaaaacgtttttgcagctggttgtgttttcagtgatttgcatttttgtcctgtccggtcttacgatccagtcagcggcaaagaaatcaagcgaactggcaaggcagcagctcggcgggagcgtcacactccaggctgaccgccaaaagcaaatggcgcagcagcaaaaagacggtgaaaagaggacgtttgaatcaacgccgatttccgtctcggatgccaagaaacttacatctttacagcacgttaaaaattacaacttcctcacgacagcgtcagcaaacgcagaaagctttgacgcgataaaaagctcagacgaatcagccgataacagttccggcggaagccgttttcaaggcggcggaagacagatgatttcagcggatatttcggtcgaaggcgtgctctctacggcgctgcttgatgatttcacaggcgggagctcaaaaatcactgatggccgcgccatcacaaaaacagatgcggacgcaaaagtcgcagtgatcaatgaaacgctggcagatcaaaacaagctgaaggtcggcggctccattacagtttcctcagcagcggatgattctgtgagtacaaagcttaaaattgtgggaatttataaaacaacatcatcaggagacgatcaggcagagcatttttcattcttaaaccctgacaataaaatctatacgccttacaccgcagctgcggcgttaaaagggtctgataacaaaaacagaatcagctcagccgtttattatatggatgatgcaaaatatattgactcattcgttgcggctgcgaaaaaaacatctatagatgataaaacctacacgctgacgacaaatgatcaggtgtatcagcaaatggccggcccgattgaaaatgtcgcgtcattttctaaaaacgtggtgtaccttgtatccatcgcgggcgcggtcattctcggattgatcgtgatgatgtcgatcagggaacgcaagtatgaaatgggtgtcttgatggcgatcggcgaaaagcgctggaagctcatcggacaattcttaacggaaattctgattgtcgcggttatcgccatcgggatcgcatccgtcacgggcagccttgtggcgaatcagctcggaaatcagcttctttcccagcaggtcagctcagccgatgattcccagcagcaaacaagcggctggggcggaggagaaatgccgcggggagacggcatgttcggtcagcattcatccggtgcagatgtcatcagtacaatgcaggtaaacgtttcgctgaatgaccttctgattctcggcgggatcggcgtcgcaattgccgtcatcgccacattactgccgtctgtatcagtcatgcggcttcaccctaaaacgatcctgaccaagcaggaataagaggaggcagcataatgagcctattaacctttcaacagatcggctactggtaccaagataaatcacagccgctgtttcaggatataacgatcagctttgaaaaagggaagttttatacaattgccggcgcctccggaacgggaaaaaccacgtttctgtctctggcgggcggccttgacacacctaaagagggaagcatcctttataacggagaagacatcttcaaaatcggattaaccaaattcagaaatcaatatgtctctatcgtctttcaatctcatcatctgatcccgtatatgacggcgctccagaacgtcacaaccgcgatggagattaccggatctaaggagaacaacaaagatgcgtccgcgctcagcatgctggataaagtcggcatcaccgaacagcaggcccgtcagcgggtgctgacattaagcggcggacagcagcagcgcgtttcaattgcgcgggctttctgctgtgacacggatctgatttgcgcggatgagccgacgggaaacctcgacgaggatacgtcaaaggaaatcgtccggctctttcaggatctggcgcataaagacggcaaatgcgtcatcatggttacgcacgacgaacaaattgccaaagtgtctgatatcaacatccgcttatcaagaggaagtttcacggtcaaagaaaacggcacggccgtttcctgataccgcgcccctgccagcgcagacaggggcgcaccctatatccccctattcaatagaagtgaacgtaaaaagagccagggctgcatcccctcgctctttttatttatatcagctgtaaataacggtcaatatttgattgtccggctgctttgatcaattcttccgcctttttctcttctcccggcaaagcgagccggagcttgtcttcaatgtctttttcagaaagaccgtttcccggcgctcccctcggacagtcgatacgtgcttcatagacatgaccgccggaaaccgtgacccgtacaattgtaaaacggcccttcggaacggcgttgtcagccggctgaatttggtcatcgcagctgcggtgaatccgctcaaatcctttttgaagggattgcggaatcggctcggatgtgaaatgttcaactgaaaaatccttaccgtgcaaagctaaggtgatcacatattctacgctgaaccgacccgcttcgcctgttttcggacgccgttctgtcaatgcggcgtccccgcccggcggataaatcacgtcaatccgttccgtttggccgaaagtgagaccatgttcggccttcagcttgagaatggcgtccgccgcatgatgggccgccgagcaaaacggataaaccttaaaccaaagtcccggactcacgatccgccaagggtttccccacccgtttacaagcagggtttctgcccgttcaagatcgccgtacagtccgaaaaaacctttctccccgtcgagcgcatgagctgagccgccgaaaccggcctttgcaagctttacggcgaacaccccggcttgagcggccaggccggcgtggagcggcttcatttctgtcccgaattgcactctcatgcctccggaacgggcagccgcaaacccgattgctttctgtaattgggtttgattcagattctctgcgaatccgacggcgcatgcggccgaaatggcacctaacgttcctgtattgtgccagcctttctcgtaatgatcccttccagctgactcgccgagccgcgccatcacttcgattcccgtcacataagcaccgagaaaacggctcttgtctatccggccggctgatgcggctgcaatcaaagccgggaggatgaccgcgctcggatgtcctcttacatcagaatgaacatcgtcaaaatcaagcgcatgtgcgatgaagccgttaatgagcgcggattgggacggcgtggttttttgatttctgccgataagcggcgctatcggcatcccgccttcttcttcggccagttttaccagcttttcaactcctgtatcccgtctccccgcaaaagcagccgctgtaaaatcaagcagtcctttgcgcgcttctttcatcgcttcggcggatgtttccggcacagacgacatgacggcctgagcaagtccggccgtcagattttccgtattcattccgtctgctccaatacattgacggcaagccgggcgaaaaactcagccgctttcggaagcgctttttcgtcgagtgtaaaggctggatggtgccattcttctgttccgtttgttcccatccagacgaagaagccggggattttttcttgatataatgcgaagtcttcgccgccgggcgactgttctgcccgaacggtttgaagtccgaggctttcagccgtttgttccgccgcctgtatgaatcgggcatcgttcatcactgacggcaggtaaggaaaccagcggaagtcagcctctgccccgaatccggccgcgattccttcggcaacccgcttcatatgtttcggaacagcgtcccgcgcttctttttgaaacgtccggacggttccttccatttcaacatggtccggaatgacattccaagaactgcccccctgaactcttgtgatgctgacgacggcattgtgaagcgagctgatgtttctgctgacaatcgattgcaggccgccgatgatctgccctgtcgcctgaatcgggtcaatgctgttgtcggggattccggcgtggccgccttttcctttcacggtgatttcaaagcggtcgacactcgccataagcgggccttctttcagaccgaccgtgccgacggggaggtcaggtttgttatgcatgccgaatatcgccgatacaccgtcaagcgcgccggcttcaatgacctgtcttgctccggcggcgatttcttccgcgggctgaaaaataaaccgcaccgttcctttcagctcatgctttctctcatttaataagaaagccgtgccgaggatagatgccgtatggaaatcatggccgcatgcgtgcatcacgccgctgttgcgcgaagcaaacggaaggtttgttttctcttcgatcggcagtgcgtcgatgtccgctctgacggcgatgacggggccgcttttatctcctttgatttcagcgatcactccggtttgaagtttcggcacatcaagaaccgtgattccttcttcctccagccagcggcggattttattcgtcgtttcgaattcctcgcctgacagctcagggtgttcatgaaggtcgcggcggatattgattaaacgtttgtttaatgattcatacgtttcatttgccatttcttcttcttcccttcttagacaagttcggcaggctctcccacttgcttaatgaattttttcgtccgttcgttctgcggattgtcaaacagctcctccggtgttccctgttcgatgatgcgtccgtccgccataaaaataactttgtcggctacttcacgcgcaaaagccatctcatgcgtgacgatgatcatggttgtctgtttttcggcaattgatttgatgacttggagcacccctgctacaagctcagggtcaagggctgaagtcggttcatccagtaaaatcgcgtgaggatcaacggccaaggctctcgcaatcccgatccgctgctgctgcccgcctgacatcgtaatcgggtagctgtccgctttgtgttctaaaccgacttgccgcagcaggtccataccgatctgttccgcttcttttttcggtttcttttgcgcggtgatcagcgcctctgtcacattttgcagggcggttttgtttttgaacaggttgtaattctgaaacaccatcgccgtctgctggcgaagcttgtgtacgtctttgcgcgaataggacgctgcattcagctttgcatcgccgatttcaatgatgccgtcatccgggcgctccagcagattcagacagcggaggagcgttgattttcccgagcctgacgggccgatgatggccgtgacttcgccgcttttgatctcaagatcgatcccgtcaagtacggtaagatctttaaatgcttttcgaatatgtctgacttgtatcatcctgagcctcctcctatgtgcgataaggcttgctgatcgcccgttcgagcagatcctgcagcacactgtaaataatcgtaagaatccagtacatgaccgcgacggctaaatacgtctcaaaatatttgaggttgcccgatgcgtacatttttccttgggcgaacatctccatcacacctaatgtaaaagcgagcgatgtttcttttaacaggccgataaacgtatttcccgtcgcgggaagcgcgtttctgacggcttgcgggaaaatgatccgtctgtacgcctgggattttgtcattccgacagacagacaggcttcaagctgcccctcatcgactgagttgagcgcagcgcggaagatttcagccaggtaggcggcatttttcaggcttaacccgataatcgccgcagttaacgccgtcatcttgctcatcccgggaaagagctgaggcaggccgtaataaattaagaaaagctgcacgagcgtcggcacgccccggaaaaatgaaatatacacctttgacagctggtgaagcacaggaatacgatttttgtgataagcgctaatataaggccgccgatcacggcaaataccatggccgcgacggccattagtaatgtgatcggcaaggcttcgattaacgcgggaaaagctgaaaacataaatccccaatcaatgctgttcattctcgattttcaccgccgtttcttattgctttgcttcctttgtgatatcttcgttaaagtacttttcagacagctttttcagcgtgccgtctttccgcaggtcttcaatggctttgtttacttttttgcggattttatcgtgagccgcatctttcgcaaacgggaaagcgactttttcatagacaatcgggtctcctgctaatttcagaggcagaccggtctttttgatctgggcgatcaggacgctgcggctgtttacataggcgtcaacccgtccgtaagccacgtctttcagcgtaccttcttgtgtttcatatgtttttatgttgatttttttatccgggtccttgctctcaaggtttttcgcgtggtttgagcccagaacggccgccactgtttttcctttcagatcattgactgatttgatgtctttgttatcgtttttgacgacgacttgagtgcccgcatacgaatacggttctgtgaagttatacgttttcttgcgttcgtccgtgacagcgacctggtttgaaatggtgtcgagtttgccggtctggagctcgcccatcagtccgctgaactcaagcagcttccagtccagtttcatgttgatttttttcgctacggcttccattacatccacgtcaaagcctgtcagcttgccgttttctttatatgcgaacggatagctttgtcccgtagcgccgacatgcagcacgttatcgccgccttcgctttcttttccgtttccgcatgctgttaagaccgccaaaagcgcggcagacagcagcaaagcccatgttttcttcttcattgaaatcccgccttttcctattaaaatgttaatcctgcaattgtttttttaaatagatggtgatgtggccttttcctaaatccttttcgcctgcgcggacgtagcctttccgctcgtacatgccgatcagccacggatgcttgtccgctgtgcccagtgacacgaaaggcgcttttaatgtatcgcggagcactgtgttctccagccactccagcatgtctgagcccgtccctttttttccggtttcaggatcgacggcgaaccaccaaatatgagggacaccgtacggcccgggattcggcccccacggcatccgcagagaaatcgtcgccagaatccgtccgtcttcctccaaaacgtaacaggcgtttttttgtatgttattcaaaacgagctccttatccgccgttgctgcggcaaagttgatgccgagcttgcggatcggttcatacgcccgcagtgtcagtgaaagcagctcatcagcgtctgcctccgttgcgagccggtattgtcttgacatgatgagccctcctttagtcggcatatcggtttgccggtttttccagtccgaaatgttctctgagtgtggttccttcatactcttttctgaacacgccccgttcttgcaaaatcggaatcactttgtctacaaaaagagtgagaccttcaggcaaaagcggcggcatgatgttgaagccgtcacaagcttgttttccgacccattcttccatcttatcggcaagctgttcaggcgttccgacaaagatatgatggcctcttgaacccgccacatatttgtacagctcgcggatggtcatgttatcgcgtttggccatctcctgaacgagcttgaaccggcttttaacggcattcgacgcatccgcatccaattcaggcagcgggccgtcaagcgggcaggcggaaaggtcgacgccgcccagatagttttgcagaatgttcaggccgacagacggaatgatgagatcttggagctcttcatattttgcctgcgcttcttcctcggtatcggcgataacgggaaatatccccggcatgatcgcgattttttcaggatcacggccgaaagaagccgcttgttctttaatagattgatagaattcctgcgcggactccaaatgattttgcgcggtgaaaatgacctccgccgttttggcggccagcgcttttccgtctcctgatgatccggcctgaataatgaccgggcgcccttgaggtgtgcgggcgacatttaacggccctctcacggagaaatatgttcctttatggttcaattcatgcattttttctttatcgaaaaatgctcctgactctttgtcacggataaaggcgtcttcctcccacgaatcccataatcctttgacgacttcaacgaattcttccgcgcgctgatatctgagatggtgctcaagatgcttttcgccgctgaaattaagcgcggtcgattcaatcgaagatgtgacgacattccagcccgctcggccgttggaaagatgatcaagcgatgcaaattgtctcgcgatatggaacggttcgctgtatgtggtagacgcggtcgccgtcagaccgatgcgggatgtgacctgagcgagcgccgacagcagcgtaaacggctcaaagcgcgtcagcacattcggatgtgatttgccgtctattgataaactgtccgccaaaaacagcatgtccaatttcccccgctcagccgttttcgccagttctttgaaataatccaaattcatgctcgcgtccgccggtgcctgaggatgtctccaagaagcgacatgatggccggtgcccgcgagaaacacaccgagtttgatttcttttttctttgtcatgatggatctccttctattctgaaatacggttcggaaaatattaacaccactaaacctatatttcctagtaattttataagaataaatcaaaatgtacaattgtcacgcaagtttgtcaatgcattaagacaaaaatcatgattttaaaaataacccggcgcaccgtccgggttatttcttcgaaactgtatagacggtccctttgacctttttcttaataacggcaatgataagcagcaaaacgggaaacagcacttgaaacggaagatgaatatagatcggcacaatgtttaagccttcattcatgtgttccgaaaaattgcttgcgatgctgatggagagaatcagcacccccaatccgaccggaaaggccagctgagacggatttttttctttaaacagcgtggacacacccacgacaaccgcatatgtaaaaaggctgactttgaaaaaaccgccgatgacgagcacgagcatgaaaaagacatccagccggtctaaaaactcttctactttaatcgtctgtatggtgctcagcagcggaaattgagagcggagcattaagttgacgtccagcacacaaatattaatcgccactgacatcgccaaaaacagcccgctgatgataatcgccagaaatccggttttcttcacctttttccgatcttttaaataagggaaaatcatgacaaacacgattaattcaccgaacgggatgaacatcgtctgtttaaacacggaataaatgaccgttcctgcaccctccgctaaaacgggctggagaaatctgaggtttatcgtgcctgagctgataatgaggatcagcccgacggctgtcagaaaatacataatgccaaacagcagctcgccggctctcgctatcacttcaataccctttctgaccgcaaatatcgcggcgatcatcagcatggcattcacaattaaaagcggcgtgtcctggtaggcgaaggtgacaagcatttcgccaaaatcccgcaatacgcgggccgcgatataagaaaaatagagaatataaagaagcgagaccgcccagctcagatgtctgccgatcagttcgttcatgtaatctctcggagaagactcaggaaaaaattgatacagcgcctgataaacgtagaaaagtccgagaccgataacgcacccgagaagcacggacagccatgcatcccgcccggccatcgtgcctggcgggatcaataacgaactgcccaattcaaacaaaatgatcataataaacagctgacgcgtgccgattttcgcattttccatacgcttcgctcctttctcctcaaatcaatcatgctcaagcttgtctgagagaggattattccgcaagcccgttcttctgataatgacttccgttttgacatctacggggagattggggaaatattcttcatcccacttccctttgaactttttccatttgtccggatgcttccgatagatcaggtctccgaagccgacgaagtcattcttacgggcttttatatcttcaattgatttggtgatatctttgtcaagctgcacgctgagcgccttttgcatcgtcatcagcacttgcggatcagacagatggaaagggtatctgacagcgtccaccagcccctcgacctgagcatgcacgtgaatatgcggttttccgttcggaaaagtggccgtcacctttgtattctggcgggtgacctgcagactgattgcgtgcttcacattcttccaatccgcattgatgaacgtatgcttgatcctattgagcagccatacagcccccacactgtcgtcatcctcaatccagtaatccagcctcccatcctttttgaacaccgccagtccgtccgctgacagcactgctttcggttcagtcgtctgcgtattttccatcgtaggaccggctttatcgtctccgtgcatttcataacccggaataaacggcgacccggccggagaagcgagatcaatcagaacgtcctgaaggctggttttaatgactctgccgtattgttcctgcgtgaagctgagcgtcttgttcactttattggaagggattttatcaatcggcgtcagcactttaataatgtcttcagccttgcaattatgcgcgatcaccgcggttgcggtcgtcctgaattcggtgtcgcggtcaagattgtccagaataaaactgagcccttcctctttcgccagcttttcactgaacaccacgagattcgtatgcgcaaaatagagccttctggacactttcatcgagccttttctcaaagcttccgtcatattgtctccggacaccgaatagacggaaaccggaggccggtctcccgctccgccgccctgcagaccgccggccacgtttcccggattgataatttgcaagtgaaggacgtattttcccgtttcggtccggtcaataccgatggcggagatcacagccaaatcagtcagctcccttttatcccagcatccggatacaaacataagggaaaccatcgtacaaaggataagtatccatttacgtcttttcattaccgtcgccctcttctacatctttattaaccatccctctggatgtctccggtttcggtctttgatgttccccttggcgcctgttgttttcctgcacgagcagttccggccttttttcatctgcccataacggagcgcggaggatggaatccttcagcccgcccggggtcaaaggagcgagcggggacatatacggaaaaccgaatgaacgcaggccgcacagatggacgaacatcatgataatgcccagaatcagcccgtaaaatcccatgaccgccgctgacagaataaagagaaaccggatcagccgcgcggatatcgccatgtcaaaagccggggtcgcaaagctggcaatcgccgtcagcgcgacgacgataaccatggccggggagacgatgccggcctgtacggcggcctggccgatgacaagcgctccgactatggaaacggcggagccgacaactctcggaagccggacacccgcctccctgagaatctcaaaagccacttccatcgtcagcgcttcaatcacggccgggaacggcaccgtctcccgctgagccgcgatgacaatcagcagctgcgtcggaatcatttcctggtgaaaggtcgtcgccgccacataaatccccggcgccaccagtgaaatgaagaaaatcaaaacccgcagcaccctgatgcttgtggcgatatcaaatcgtgaataataatcctcaacggattgaaaaaattgaataaataaggccggcgcgatgagaacgaacggcgttccgtccacgataatcgcaaatcgtccttccagcagattccccgccacgacgtccggccgctccgtatgatatacggtggggaacacagaaaacggcgcgtcttcaatgagctgttcaatgtagccggattccaggatgctgtcgatgtcaatgtgcttcagccgcttgcggacttccttaatcagctttttatcgcaaattccgttaatatacatcagcgcgacatccgtattcgtttcgtgtccgatctccattttttcaacccatacatcaggcgtttttacatacctgcggatcatggaaatattggtttgcagagattcagtgaatccctggcgcgggccgcggaaagagacctgagtgctcggctcttgaatggaccggtgctctcccccttccgtgctggcgatcagcgccttgtcagccccgtcgacaaaaatgagcgtgctgcccgccaccagcccggcataaaggcttttccatttttcttcctctttcaccccgccgatcgcaagcgttttatcgtatatcaggcagaccgcttgttccggctgaacggacgggatatcgattaaatcctccagaagggattggctgacaagctgttcgtctaccaaaccggcgatatacacgattgcggccggaagctcttcttttccgattttcagccggcggatgacgacatcggcactgttgccgaacctctcagacagcttcttcatattttgctttaagctgagggagatcggctcatcccgctctttgtccggctggctgtccgcttcttttctgccttcattgtcacggtcgttttgatcggcttttttttgtttcctctgcttaaaaaatggcggcatatcgcaaaaaacctttcctcgtttttttcatattcttcctgtacggcaaaagattatgcacggcggaaagtctgtataagttctgcgtaatcgaaaaggataaaaagggagagtgatgcgcatgaaaatattaggggtttcattctttttgctgactgcctgtctgatcatttcagtaacggtggatatgctgcaaggtttcagtttctatggagcggttcaaaacaacctgtccgcttttaaattgaccaccttctcagaatggctgatgctgtttttattcgccctctttttaatcagagaaatgatcgctttatataaatcaggtaaaaaagatgcctgacaggcgcaaggctgtattgtgtcaaaaaagaacacattcctccttctctcggagttcatgtgttctttttatttttccggcgcagattgttctcagatgacgatatttccgctttccgtatctgtcgcgtgcttcacaatgacgcctttgataatgcggttgccgatgattttagtacttgcggaggagctggtttggatggcggaagcagaagcggcggataggttgttgatggtattgcccgaaacgagggaattggaggctccgttcagatagatgccgatcgggctgcccgctgttcggttgatcgtgagcgtattgtctatgacttcatgcgtgcctgagttcagatacacggtaacgataagcggtgatgattcaaagcggttgctgatgacagaggttcccgaggatgttgaactgaatacgggatagtttttatagttcttaaagagattgcctttgatgacagccccggcgtcatttgtcacagatacggcataggactccgcggcgccctgatacgcattcggaaggagcgtatttccttcaataacggcatttccgcctgtgacccatatgccccggctgaacgatttcagcacattttgttttacaatgatactgccggccgacatgctgattccgtctgtcacctgattcagagtgttattcgtaaagacggcgttctccgaaagcgtcgcccgcatccccgtgcttcgtctcgtttcggaacgtccgttttcaatgacattgccgtcaacggtcacatcttctgcctgatagacggaaatgcccgtattttcaaattgattaattttgttgtgggtgacgaggacgctttttccccttacatctattccggtggaaaacccggtaatcagattgttggaaatgacggcactgctgctgtcctgtccttgtgacacaccttgtccggcgactgcggtccttgagccgccgtctgaccgaaagaagacattccccgtaatgacggtatgcgccccatacccgtagctgattgtgttatcggaatgatttccttcaattaacacattatatccgttaaaattggtgactgagcttgcggcgtttccggaaaagaagttgttgcggaccgtaatatgaagagcttcttcataatcaatatcgccttctccgtacgattcaatatcgattccgaatttcggagccgttccgttcccttgcccggcgtcttcaatcacgcattcttccaccgtaacggtattgcagccggtgattgaaatgttgttccgccttgactgcctgatctcacagcggcggatggtcacctgttctgaagtttcgtaatcactgtttgtttttaacccgagcgggctgacaattataccgtctcccgtaaaatctgaaatcttcacattttcgatcagcacattgctgctgccttcaatacagattccaaacccccattcatgggtcgaccgcaaagggacattggtatacgtgtgttcatcccgttccccgatgatccggccgccggtgatggtgacattttcacgcctgcctatatagaaagccgagtagccccaggagctgttcggcgccactttaatcgtgcattccggatctaaaacgatggtgagatggctcggcacgttaatcccggcgttccgaaacggctggcttttgtccccgccaagcgtgccgttgattttatacgttccgggcggaaaaaacaccgtatgacagccttcgctgacggctctggccaagcattggttgatggcgcccgtcacatcggtttttccgtctgccgccacaccgcaatccgtaatatccaatatacgattcggcaagtgataatctcctccttcctctcttattgtcatcttattccgccatatcccgctccgcctgtacatactttaaattttattaaaaaagtttataaagatagtttagtcagataatataacaaaataagtcattggaatcaggaaaattcgtctatattcaccgttttaatatcttttcattctggaattttttgaattcagtataaattatattgacacaagtattatataagaatatgatttttgtaatacacttttttaagaaagggttggctcaggtggcatctattgataaggaatctataacagaaactgtgccgcaacgaggctttttcggtcatccccgcggcttgttcacactgttttttaccgaattttgggagcgtttctcctactatggtatgagagccatattgctttactatttatacacggaagtcgctcatggcggtctcggctttgataaaacgaccgcagttgccatcatgtccatatacggatctctcgtatatatgtcgagcgtcatcggcggatggctggccgaccgggtattcggcacggcaaacaccgtattttacggcggaattttaattatgttcgggcacatcgctcttgccttccccggcagcacggcggcgttttttaccagcatggctctgatcattatcggaaccggcctgcttaaaccaaacgtatccagcgttgtcggagatttatatacgaaggaagacgagcgccgcgactcaggtttcagcatcttttacatggggatcaacctcggcggattgcttgcgccgctaattgtcggaacactcggacagaagtacaactaccacttaggcttcggatgcgccgcggccggtatgttcctcggactgattgttttcgctctaacgagaaagaaatacctcggcaaagcaggctccaatgtaccgaatccgatttctaaatcatcagtgatcggcacgggaatcggagtggtcatcgcagcagccgttattattgttctgattcaaaccggctggctgacgatccagcgtgtgattgacaccgtcagtatcctcggcattgtcattccggttatttactttatcgtgatgttcacaagcaaaaaagcgacgaaaacggaaaaatcacggcttgcggcttatgttccgctgtttattgcagcggcaatgttctgggcgattcaggagcagggcgcgacgattctagctttatatgcggatcagcgcacgagactttcctttgcgggcatgcatcttgagtcttcatggttccagtctctgaacccattattcatcgttattttcgcgccggtgttcgcgtggatctggatgaagctcggcaaacgccagccttcaacaccgattaaattcgcgatcggcattatccttgccggattatcatttttagtcatggtgcttccggttatgggcggaagcggcgagcttgtgagcccgctttggcttgtgctcagcttccttttggttgtgcttggtgagctttgcctttcaccggtcggtttatccgtcacaacgaaacttgcgcctgcagctttctcagcgcagacgatgagtatgtggtttttaacaaacgcctgcggtcaagccctgaacgcaaaagtagtcggtttgtttgataagatttctgaagcggcctacttcggctcaatcggtcttgtttcgatcattctcggtattattttaattcttctgtctcccgtcattaaacgggcgatgaaaggcgtacaataaaagagaagcctgcggaatcgtccgcaggctttttttgtgcgtctatcgttttaactcctcaagtgtttctctccatctcttcaggacatcttccggttcgtggagctggatggccggtcctgatgtcagatccgcgtatttcgcccgatcttccttgacggtgatcacgcggcagctgaaccgttcccgctcgtgtttcgcctctttcaacggcggaagcgccttacattccaatgtgacgtaatatgcggctcctccgtgccaggcgatgaaaagagcttgtcccgaatgcagcaggctttttacggtcgtcgtgtttttccataaggcgagccggagatttgttctgctcacggccgcgatttcaccggcgctgatcatggccgcgtgcggacggccttcttttgtcacggattggagcacaaatgcgtcgtgctgctttttttcaagttccgttccgtctaaaagcgcgtaaagcgcctccggcaagtgctccgtcagcattacgcttttctttccgggacagcgggaacatgtgtggccgtctctgtttctttcggatcgattttaaatgccgggttgaatgccgccggattcgtgatactttccggttcacaggatctccatgtgaaaaagcaggtttggcattggtatatttcccaagcgcctttgaccggcgattggctgacggtttctcctttttgcgattcacatcgcgggcatgttttcatagtaaactcatcctttcttattgattcattaagtccatcagtttttgttcccactctttcgttgtcagcggggaatcaagcggctgcgaataatggcctcttgtttccggcgcgacaggcgtcgtggcgtcaagaatcattttgtgtgtcatccctgccggatcagaccccgggtcaagcggaaggacggacagatcaggaatgatgactgcatcgtgtttcggatgcattttcgttgagagcgcccacatgacttgcggcaggttaaacggatcgacatcctcatccacgacaatgaccattttgcagtagccgagtccgtgcggcgtcgtcagggcgcgcatgccgacggccttggcaaatccgccgtagcgcgttttcgtggagataatggcgatcagcccgtgcgtatacatcgcattcacggcgacgatttcgttcggataggcttccttcagctgctggtaaagcggcacgcacgtattaatgccgatcatataatcgcactccgtccacggcatgcctaagtataaatgttcaaaaatcggattgtttctatgatatacccgtttgattttgatcaccggcatgctgcggccgcctgaataatggcccgtgaactcaccgaaaggtccttcgtattcccgttctcccgcaaggatctctccttccagaacgacttcagcaccccaagggatgtctaaatcagacaatttagatttaacgattctgtagggctccccttgaatcgcgccggccatttcatactcggattgatcgtataacagcggagttgatgcagccgtcgtaatcaccggctcacagccgagcgcgatcgtaacgggaagattcacgccgcgttcttcagcttggcgaagatgaatcgcaatatcatgctgaggcacgggctgaatgccgaggcggtctttcccctttacctgcattctgtaaatgccgacattctgcttgccgaaattgtccggatcttcaagatcgcgggaaatgacgcacgctttatccaaatagtagccgccgtcccctggttgattctgaatagcggaaggatgtcaaatagattgatatcttccgttatttcattttcatgaaacggcgcggtttcttcccgtttgaccggcaccggaaatgcatcgtaccgtttggcaaactcaaagaattgttctttaacaggcgtatctttcggcatgccgagcatcatcgcgtgattcggccacgagccgatgacattcagagccacctgcgcatcgtgatgtccgtaaatattgttaaacaaaagcgcaggggttttatccccgagattgctggctgcacgcgcggcggcgcccaggtccggctccggttttacctcttcgttgacggttaagagctgcccttctttttcaagagcggcgagaaattccctaaaatcctgataggccattatcagattcctcctttttgtttttcaattccgtaccaccgtttcgcttccggcagacggatgccgaactgatcgagcgtccggaacacaatatggtctatcaattcatccatgtcagccggcttgttatagaatgccggcatcggcggaagaatgacggaacccatttttgtaagcgctagcatattttctaaatggatttggctgagcggcgtttctcttgtcagcagcacaagttttttccgctccttcaggatgacgtcagccgcccttgtcagcagattgtcagccattccggtgcggatgcttgccagtgatttcatgctgcacggagcgatgatcatcccgtccgtttcaaacgaaccgcttgaaatcgccgctgcctggtctttgtgagaatacgtataggatgcgagtttctcgacatcttttaacgtataatcggtttcatgtgtaatggtgacatttgcccaaggagacacgacaagatgggtttcgatctccgcggcttttaaatattctaaaagcctgatcccgaatatggctcccgttgccccggtcattccgatgacgagcttcatattgacccctcctttacgcttgaaatgtggtgtcaaatccatcatactcctgatatatccatatgaaaaatattcgttaaatctatgtatcataccttaaaggtataaaagaaaggagcgagcgttctcatggatattcggcaattgcgttatttcatcaccattgcccaagagcagaaaatcacgacggccgccaaaaagctccatatggcacagccgcctttgagccgacagttgaaacagctcgaagaagaattgggcgtcattctgtttgaccgcaataaaaagaaacaaatgaccctcacatatgaaggaaacgtctttttgaaaagagcgaaagagattcttcataagtttgaggacgctataatcgaggtacaagagctgaaggaggaggtggccgggacacttgccgtcgggtcaaccatttactgcgcagcgctcatgcttgagaaagtgtcacagatgaaagagcggtttccgcatctcacctttaacatttgggaagatgaacccgtctcactgctggagcttctggaaacccggcagattgacgccgccgtcaccaccaccttgattaaaaacgacggcattgaatcgaaggagcttgaagacattccgtgtgtattggtgctgtccgagcattcaaaacgactgtgcggagaaacgattaaactgaatgacatcgcctctttgcctctgatccttttgcgcaccgtcaatggaagaggtgtgtatgaccaagtcctccaagtttgtgaacagtacggtctcgacctccaggttgtttgtgaatgccatgactccgcgacgctcttgagccttgtatcatcaggattcggcgccacaattctgcctttgacgatgattcccgtccatatgcgctcgcatgtcaaaacggttatcatcgaagacaacccgtttgtcatgacaccggccgtcatctggagaaaagacagctacctgccgaagcctgtcagacagtttttggaattattttgatccggaacacgatgaattcccgcttatgaaaaccaattacttgactcatactaaaaaaaagttatcctttacaattgggagctattttttctcaataaaactactcagaaaagtggggaataaagaagatgaaaaaagcattattcgctttgttcatgatggtcagcatcgcaatgcttgcagcctgcggaaactcacaggacagcggatctaagtcaaaagacggcgatctttgggcttctgtcaagaaaaaaggcgtactgaccgtcggtacagaaggaacgtacgaaccgtttaccttccatgataaaaagactgacaaactgaccggatatgatgttgaagtgattcaagaagtcgcgaaacgcctcggtctgaaagctgactttaaagaaacacaatgggacagcatgtttgccggtttaaacgcgaaacggtttgacgtcgtcgccaaccaagtcggcaaaacaggccgtgagaaccaatatgatttttctgataaatacacaacgtcaaatgcagtcgtcgtgacgaaaaaagacagcacgattgcgaaagaggctgatgtcaaaggaaaaacagcggctcagtcattaacaagcaattacaataaattagcgaaagaagccggcgcgaaaattgaaggcgttgaaggcatggcgcaatcccttcagctcattcagcagggccgcgctgatctgacttacaacgataagcttgccgtactgaactacttaaaaacgtccggcaataaaaacgtgaaaatcgcgtttgaagcaggccagccgcagcagacatatttcgcattccgaaaaggaagcggcgaacttgtgactcacgtcaacaaagcgttaaaagaaatgaaagaggacgggactctttctaaaatagcgaaaaaatggttcggcgaagatgtttctaagtaacatgccggaacccgtgattgcaacagccattccgtgggatttggtgcagcagtcattctggccgattctttccgggggaatctattactcgattccccttaccattctttcctttattttcggaatgatcatcgcgctgattacggcgctcgccagaatgtcaaatatgaaaccattgagatgggtgttcagcgtatacgtatcagcggtgcgcggcactcctcttctcgttcaattgttcatcattttttatctgttcccgacatttaatattacgctggaccctttcccaagcgcagtcatcgcgttttcattaaacgtgggcgcctatgcttctgaaatcatccgggcatctatttcatccgtgccgaaagggcaatgggaagccggttatacgatcggcatgacctatcgcaagacattgttccgcgtgatcctgccgcaggcgtttcgcgtgtccattccgccattatcaaatacatttatcagcctgatcaaggatacatctctcgcgtcacagattctcgtcgcggagctgttcagaaaagcgcaggaaatcggcgcgcaaaaccttgatcaaatcttggtcatctatattgaagccgcctttatttattggatcatctgcttcttgctgtcaatcgtacagcatgtgatcgaacggcgtctcgaccgttatgtggccaaataaggaggtttcgatatgctttccgtcaaaggattaaataaatcattcggacagaatgaaattttaaaaaagatagatatggagatagaaaaagggaaagtcatcgccattctgggaccgtccggttcaggaaaaacgacgcttctgcgctgtctgaacgcgcttgagatccccaatcgcggcgagctggcattctccgatttttcaatagatttctccaaaaaagtgaagcaggctgatattctccgcctccgccgcaaatcaggcatggtctttcaggcgtatcatctgtttcctcaccgcacggcgcttgaaaacgtcatggaaggacccgttcaagtgcaaaagcgcgacaaggagcaagtcagaaaagaagcgatagagcttctggaaaaagtcggactgaaagacaaaatggatttatatccgttccagctttccggcggtcagcagcagcgggtcggcatcgcccgcgcgcttgcgattcagcccgagctgatgctgtttgacgaaccgacgtcagcacttgatccggagctggtcggcgaggtgctcaaagtgattaaggatctggcgaacgaaggctggacgatggtcgtcgtcacccatgaaatcaaattcgcgcaggaagtggccgatgaagtcatcttcattgacggcggcgtcattgtggaacaaggaccgccggcccagattttttccgcgccgaaagaagaacgcacgcagcggtttttaaatcgtatactgaatcctttgtaggagccggagaagaagcgaaacactgatttcgcttcttctttttttgggcggttatgctacaatgacaattaatgaatgttatgaaagaagggacctctttgaagcgggaattcttgatgcgctggacgttttattttgccggtctgttgattttgtctttcggggtatcgttaaccattaaaggaaaagctctcggcatcagcccttgggatgcctttcattatgggctttttcagcatttcgggctatctgtcggccaatggtccatcttggtcggcgcggtcatcgtggctttaacctgcctgttcacgaggacgctcccgaaaatcggcgctatcttaaacatggtgctgatgggaatgtttattgatttcttctcgtttctgcttcctgaggcgcacgctttttccttagcggccgtgtttttttctatcggattgctgctgatcggctgcggcgtcggtatttacgtatcagcagggctcggcgcgggcccccgggactctctgatgatgctgatatctgaaaaaacgggctggaacgtgcaatgggtgcggaacggcattgagctgacgattcttgccgcagcctgggtgatgggcggaccgatcggcgccggaaccattattacggctgttttgacggggctgattctgcgtttttctttgccgcagtcctctaaactgttaacatacgcgatctccgggcgggcaacgtccgttcattaaaaacaaagccgaaacggttttgtttttttattttcggacagctttcgtctgatatggtaggatggttttgacaatattttcagacggaggatctggacatgaagatttacggagtatatatggaccgcccgctttctgcaggggaagaggatcggatgatggcggccgtgtccgccgaaaagcgggaaaaatgccggcgcttttaccataaggaggatgctcaccgcaccttgatcggcgacatgctgatccgcaccgctgcggcgaaggcttacggacttgatccggccgcgatttcattcagcgtccaggaatacggaaagccgtacatccccgcgcttccggacatgcactttaacatttcccactccgggcgctggatcgtgtgtgccgttgattcaaaaccgatcggcattgatattgaaaaaatgaagcccggcacgattgatatcgccaaacgttttttttcgccgacggaatacagtgatctgcaagcgaaacaccccgatcagcagaccgattatttttacctcctgtggtcgatgaaagaaagctttatcaagcaggccggaaaagggctttcccttccgcttgattcattcagcgtccgcctcaaagacgacggccatgtgtccattgagctcccggacggacatgaaccttgtttcatccgcacatatgatgcggacgaggaatataagctggccgtttgtgcggcgcatcccgatttttgtgacgggattgagatgaaaacgtatgaagagctgatgtaagcatagaaaaaggagggtatcccctcctttttttgtcagcctgatatttccgcctgtttctgcagctgctttgcttcttgataaatttcttcgaacagatccgcgatgtattcttcttcaacacatgaaaatgcgattcgcaaatcggtttcattaatggatatcgtcccgattcctctcttttcaagcaacgacactcttaattcgccggcgtttatgtctttcagccggacacacatgaaataacccgagttaaacggataaggcgtccatacgtcttcatagtgcttgttttctgcaagaacggctttcactttgtcagcccgttttttcatgatattatatttcagcgatttttctttctcgtattccggtgactgcatcgcccgcagcataaacgtttgggacggatgcggggcgcttgaaatcgttcccctgataatcccttttgttttttcctcgagcacgcgcagcgctttttcgctttttgtgctgtacgtaataaaaccgacgcggaagccccacgcgtaattttccttcgtcgcgccgtctatttttacgcaaagcacccggtcgtgcacttgggcgagtttgctgaagatggattcctgaatggccgtttcatcgtaaaacagattgtaatacgcatcgtctacgagcacgacaatctctttgccggcctccgctgcctccaggatcacactgacgatttctgacgcttcctcttcccccggcgtatagcctgtcggattattcgggaaattcagcacgacaatcgccttttcttcctgctttttcagcagctcggacagccccgccgcattaaaacgcccatcctgctgaaaaagcgggtacgtctcaatggatgccttgcgccggacaccgaaaatgaaattgtaatttccccaatatttatccggcagaagcagcgcatccccttcattgacgaacaagtcggcggcaatgctcagcccgtgtgttaaagcgtttgtcacgatcggcgtgctgatgtctttgccggctaatgaaggattttcgagacgcatttttttcagccattcctgtctgagcggctcttttccctgcggcggagcataatcgtagatatcatcggggttataggcggacagtgtctcttgaatatgggaaaagtgcatggactcgccttgtgaggtggcaatcccgatcgtggcattatactttccggccttggctttcgcttccgccgattgtgtcagcacccctttcggataaaacaactctctgcccaaatcagaaagcatatgaagcacgtgcgggttttcttcagataatgttctgttcagctcttttgctgcatcattcatgtacgacaatcccttcaaaattatattccatcaaatcataacataaaatttttgataaatgagaaaactcacgggcagattttgttacaaaaaacagacagcgaatgctgtctgtcatatcctataacaattggcctgcagtgctcctgttaataatctcatatattcgttccgccactttttcagtttcacttaatatgaacatgtggccgtccgaaaactcatgaaatacgggattgtcggcccattttttccatccgtccgcatctttgatacattttttatctttccgcccgttaaaaatatggacgggtgattgaatcatgtgagaatcagacggacggaagctttcaagcgcgcggtagtcggacctgaaagaaggcaggaaaaatgacatgacctccttattctccactaactcctgcggcattccgcccagctcgataatatgggcgagaaatttttcatcatcaagatgagacacttttttcctttcaacatgcggcggctgaatggctgagatgatcacggcctgcgggtaaatcccctcccgctcaagcttttgcgccagcctgaaagcgaccatgcctcccatactgtggccgaacaggacaaacgggcggtcaggatggagattcaactcctgcttgtataaactgacaagctgttcaaaatcctcaacggcggacatttgatttgttccgtgtcccggcggttccgcggcaagcatctcacactcaccttgaagataggtgtggagcgggcggaatgatgcggaatagcctcctgcgaacggaaaacagataagctgcgttttttccgtggtatcgaacgatttaaagagctggaccattggcgggcttcctccttttctatcgtgaagctgtcagcttcggatgttccttccttaggaattcgagcaaatatgccgcattcctttcgagacattctccctgaagcatttctgcgtgactgccgcagccttttttcacacggtattcacctgtcgtggcttcctcccacgaagcgagccacggcggcatcgcaaagtccggttctgacgttaatagatctatatccgcattgaccgtgccggtgctgacggtatgcacgaaataagaataaaacgcgtttgtttttttggcgagaccttctttgacggcttcgtcattcagcgcttcgttatcccggtttaccttcatcagcgcctggacatcgctttctacggtgcggccttccaagtcgctgacgccttgttttttataggaatcaaccatgatcagccgctccactttacgtccttcggcttcaagccgtttggccgtttcaaaggcgagcgtgcagcctgccgagtatccgaacagcttgaccggtccttccggctggagctgattgatcagctctgtgtagcgttcgatgcggttgtcttcctcgataaaatcaaacgcacagattctatagccggacagctgttttgccagcggctggtacatcagcccgtaaccgagaaccggcgggaacgcaaacagtgtgtcagactgatttttattcatgatggtgagatctttcattcctttttcttcaccgtgaagcagataaccggcaatgtctgcgattgtcgtcgcttcgaataacagctgcaccgggatgtccgtaccgagctcttttttaatgcgcgacgctgccgtcatcgcttttaaggaatggcctccgagcgcgaagaaatcatcatgaatcccgatctgctgtctgccgagaatctcggaccagatgtgtgcaatcgtttcttccgtcgcgtttcgaggcccgatccattctttcgccgcctgagcctgatccggtttcggcagctgccgtttattgaccttcccgtttgtcgttaaaggaagctcttctaagaaagtaaaggtttgcggcaccatgtaagcaggaagctgttttttcaagtgcctctttacgtcttcagctgaaagcggcgtccggttcacgagataggcgttgattgatgcatctccggactcatggcggtctgcaacaacgaccgcatctttcacacccgggtattcctgcagctgcttttcgatttcttcaagttcaatccggtgaccgcgtattttgacctggtcgtcaatacgcccggcgtattcaatcgttccatccggcagccagcgtgctaaatcccctgtgcggtaaagcgtttctcccggcttgaacggatttgggataaacgtttgcttcgtcaggtcgtgacggttcagatacccttttgatacacccattccgctgatgcacagttcaccgacagctccgaacggctgaagctggttttgcccgttaagaatataaatacttgcattgctgatcggctttccgatcggcaatgaggaaatggaatccggtatatcatgcacgacgtgagctgtcgcaaacaccgttccctcagtcggcccgtaacaattaatcagcttgccaggccccatgatctcaagcgcctttctgacgtgaggcacagacgcgcgctcacccccgaataacacacagcggagccccttcagccactcctctcccgcatcggtgagaagattaaaaagtgcggttgtcgcaaacatgacattgacattctcctgccggatcagatcagtgagccgttctgtatcaagcagtgtatgttcatctgcgataatgagccgtgccgcattcaggattgatgcgtagaaatcaaaagtaaatgcgtcaaaggcgtaattcgaaacagataagaacgtatcttgttcagaaaatgccatatagtctacatgcttgaccaatccttgtatattggcatgagtggtgatattgcccttcggctttccggttgtgccggacgtatacataatatacgccggatcatcgggatcaattgcggctgcaggatcgcttgcctgttcctcaaaccgtgcttgatcatcgatgatgagtgttgttcctgtatacggcagctgagccgctttttctttcatctcctgatgtgtcagcagacaggcagccgcactgtcagtcagcatatacgagattcggtcctccggcagcttcggatcaaccggcagataagccgctcccgcttttaatacgccgagaatgccgatcaccagttcaagcgagcgcttcgtgtacaacgcgacaacggtgtctttacccgcaccttgcttttgcaaacggcgcgcaagacggttcgcttcctcatctaattcgcgataggaaagagtctggccggaatacgtaagcgccggtgcatcaggatttacattcaccgcttccttgaaccaatccgtcagaggcttcgcctgatgagtctcagccggcgggtttaagccggtaagcagaagctctctttccttttcatcaacaagtctgatcgtattgacagggtgatccggcttctggatgagctgctgaatcgctgtgagaagctgagattttaagcgcaggataaacgcctcatcaaacacattcccgttataggcaagcttaatcagcatctcatcacctggagaagccatcaggttgagatcataattcgatttctcaaaaacatggacgtcctccatatcaaagccgttttcactgttctcttcattttttgcatcctgaagcggataattttcaaacacaataatatgatcaatcagctttggctgatcggcctggctttggatgtcatagagcggcacatattgatgaggctcagactgcagcgattgctcctgcagctgcttgagcaagccgttaaatgtggtatcctcagacagcttcacccgcctcggaacagcattgataaacagcccgaccatatgttcaacgcctttgatttctgcgggacgcccggaaacgactgtgccgaagatcaaatcgccggactgctggtagcggctgattaatacactccaaaccgcctgcagcgccgtactcaaagtggtatgctgcgattttgcaagctcggtaaatgcttttgtttccgcctccggcagtgagaagagcagctctttcggctcatagccgttctcttgtttctttctttgctccgcaaatgtcgtttgtccttcaaaatcttctaagtacccgcgccagtaatgcagtgatgcatgtttatcctgcttttcaagccacttgatatagtctttatacggtttgaccggcggcaggctgtacggcttttgttctcgcagggcattgtataccttaaacagatcctgcacgacgatgccgaagcaccagccgtccaaaatgatgtggtggtagctccacacccattcaaagctttcttccgattttttaaagatggctgcccgcatcggaatatcccgcgtcaaatcaaagcccttgatcttatcctgttctttgtattcattaattttggatgcttgctcgctgcccgttaagtgtgtcagatcgatttcttctatctgaaactgccgttttttcaatacgacttggaccggcctttttactttttcgtgaatgaacacggtacgaaatacatcgtaccggtccatgatcacattcatgctttcttcaaggcatttgatattcaagctgccttttactttcattgtcatttgttcgatgtaaaagctttggccgggattcaggagagtatgaaacagcattccctcctgcatcggcgacaaataatacatgtcctgaacttgatcttttttgaactggctcatctgctccgctcccccttctgttaactgtttttgtcacgttaaattctcctcaagcatgtcaaagatgtctcccatttcatccatctcaagatcctgcgcgctgaaatcgctcggcgtaaattctttctcctctttggccgtgcaatggcggatgatcattaaaagattgtctttaaaccgctgcatctgtgtttcgacggtgcttctttcatattcttcctgattgtatgagcaggaaatgacgaagcggccgcctgtaaccatcccgctgaagctcagtgcgtataacgcctctgactcttcgctgacttgacgtcccatatcatatggagacggctcaaaccattccgttttcacttcattgtcaaactgccccaagtagttaaaactgatttcaggcgcggcgcctttttctgtttcatcggatgacagataccggagaattccgtatcctacacctttatctggaacgcgccgcactgtctcttttaccgttttaatgacggaagagacgccgtcttccttgctgatctgcagaatcaacggatattgggccgtaaaccagccgaccgtccgtgaaatattgacgttcggtatgatttcttcccggccgtgtccttctaagttgatgccgactttgccgttttccgtccattcaccgatcgttaagccgagtgcgctgagcagaatgtcgttgatttccgttccgtacggatgatgaacatctgtcagcagctgtgccgtttcttcctcagtcaattcacatttcacggccgccgtatgtttgacgagccgtttgtccggatcatggtctttcggcagcggccggagctcttccgcatctgcctgcgcccaataatccgcctgctttttcagctcttctgattgcgcaaacgtgttcagcgcctccgcccaatctttaaaggagtgggttttttgcgggaggacgatgctgttttgctgctgcgcctgtttataacctgaagcgaaatcctccagcagaattctccatgaaaccccgtccacgacgagatggtgaaccgcgattaacagatgatcgccttgttctgtccggtattgctccgcttttaacagcgggccgttctccagatcaagactgccctgaagatgatcggcaagccgctgaatctggcttttcagcatatcctcgtccgttccgtacagatcaacgatttcaaagcttgccttgcattctgtgacagggaggtatgtctgaatgatgccttccctttcttcacggtaaaccatgcggagcgcatcatggtgttcaatcaatgcttgcagggttttttccaccaggtccggatcaaagccgtctttcgcgtgaagcatgacggattggttccagtggtgtttgtccgtgaagtttttctcaaagaaccagcgctggatcggcgttaactccgcttcgccttcgacaggtccctggtcggcctgcttgccttccgtccgctccacataagagacgagctcttcgatggtcgggtgctggaagagatctttcatctccagcttgtagccgtgctggttcaggcggctcgccatttggatgcctttgatcgagtcgccgccgagggtgaagaaattatcgcttacgccgatctgatcaagaccgagcacttcctgccaaatgtcggaaagcagcgtctccatctccgtttccggcgctttgtaagcggcgcttcccgcttcaatgtccggttccggcagggcttttttgtcaatctttccgtttgcggtgaccggaagctcgtccatctccacccagaacgccggcaccatgtagtcaggcagcgtgtctttcagcgcggctttgagcgcttcaatatcgtcctgccgaggcgcgacataggcgcaaagcgcggtattgcccgctttgtcttccaccgccgtcaccgctgcgtcatgaacgtccgcaagctgggcgaggcggacttcgatttctgaaagctcgatccggtagccccgcactttgacctgctggtcgatacggccgatgtattcgatgccgctctgcgcgttccatttgacgaggtcgccggtccggtacatgcgctcgccgggcacgaacggatctgcggtaaaccgcttcgccgtttcttcctcacggttcaggtatccgcgtgccagaccgcggccggccacgcacaattcaccggcaatgccttccggctgcacctgatcgccgtcgccgagaatataagctctcgtattggcaatcgcccgtccgatcgaaagcgatccttcctcaggattgatgacgccgcttgtcgcgacgacggtgttttccgtcgggccgtagttgttgacgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcctcgaaatagtgatttaagcgggtgatatccagccggatcgcttcgtcaatgacgtgaagctccgcgccgatggtccatgtcgggaacatctcccagatggaggcgtcaaaaccgaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagatgatccgccgttgtttcagtctgcgggttcgcttcatcgttttcatcaagcggcaggctcagaatggagcgtccgccgtcaagcaggatcgtttctcctgtgtagccatccggcacgtccagcgcttcctgtgtgagaagaagcttggcgccgctgtcctgcagaatgtagctgatccgctcttgtgggtagtcggggtcaatcggcacaaatgccgcgcccgctttcaggacgccgagtacgcccgcggccatttccaaggacggtttcgtcaaaatgccgacacgttcgtcagccgtgacgccgcagtctatgagaatgcgcgcgatccggttcgcccttgcgttcagctcgccgtacgtccatttcgcgccgttatatgccgcggccggccggttcgcgtatcgggcggccgtttcttcaaagagacggtgaaccgttttgtcctgcggcacagagagtgtttttcctttccatgcgtcaaggagggcttgtttttcagcatcgctgatcagtgaaatctcaggcagctttctgtccgggctttccgccgcttgcttcagaatccgcaggaacccggcgctccacttttcaatggtttcttttttaaacagatcagtcgcatattcaaactgaaggccgagaccttcttgatccgtaaagccgccgagtgtcagatcgaatttcgccgtgccttggtttgactcatacggagtgatgcgcaggttctccagttccagtgtttctttatccggatcttctgtcgtcaccatcacctggaacagcgggttgcggctcatatctctcggcaggtcaagctttccgatcagatcctcaaacggataatcctgatgcgccagcgcgtcgagattggtttgtttcacccgttcgagcagcccggcgaaggtctgctctttttgcgtttcattgcgaagcgcaagcgtattgacaaacatccccggcatttcctgaacttcggcgctcgttcttcccgcggtcaccgaaccgataatgatatcgcgctgtcccgtgattttgctcaaaaagacatggaacgcggcgtgaagcaccatatgaagagtcgctcccgatgattccattaattcacgcaccgctttttccgtctcacgccccgctctgaaacggacggattgtcctttaaaactttgaaccggcggacgcggaaaatcggtcggcagattcaattcaggaagctcgccggaaaatgccgagagccaataacgctcatggtctttcatccgttcggcctgcccgggttcattctgccagacggcgaagtctttatagtgcaggttcggcgacggcagacttccgcctttgtaaaggtgagcgagctctttgaccagcatgcttctggacacgccgtcggcaatgatatgatgcatatccagcagcagcaggtgtttcttttcattcagtctgacaagagcggcccgaatgagcggagccgcgctcagatcaaacggcttaatgaatgcctgaatgataagatccgccttctcctcgtccgctgcttcaaaaatgtgcaggtcaatgtcagcctgttctgcgatctgctgcatcggctggcctttttgatcgataaaggacgtccgcaaagattcgtggcggttgatcatctgattgagcgctttctgaagccttgaaatattgacttctccttccatcagaagaacggacggcatattatagctgattgtctcccggtcaagctggttcagaacgtacatccgtttttgggcggatgataacgggtacgcgtctgcactgtctgccggtgtgatcatccgatatccctcagataccgccgatttttcgatatatgcggcaagcaggcggacagtcggctgttcgaacagcgcttttaacggaaccgttttgtccagttcagcctgaatattggcgaggagcatcattccttttaaagagtgcccgccgtaatcgaagaaattatcgtcgatgccgagcgtatccgtaccgagtgtctgtttccaaatgcggcacagcttttcctccaattccgtttccggcaaggctgaagcaatttgcgccgtttggctgacgcccggtttcgggagggcgtttttatcggtttttccgttggctgtgagcggaatgcggtctacttgcacgaaataggccggaagcatatgagacggcagtgtttcggaaagccgtttgcgaagctcagagcctttcagcccgctgtcggctttatagtacgcgcacagttccggcagcccgccttcgctgactgcgagaacgaccgcctcctgaatgccgtttacgcttaacagcacggtttcaacctcttttaattcaatgcggtagccccggattttcacctgatcatccgcacggccgataaattcaatcgtcccgtcaggaagcctgcggacgatatctcccgttttgtacatcaggctgtccggtgaaaaaggttttgagagaaatttctccgccgtcagctgcggacggtgaagatatcctctggcaagccccttcccggtaatataaagctcgccgcttgcgcccggaggaacgagctgcattgctccgtccaatacaagcgcgccggtatttgcgatcgggcggccgatgacgggacgctgctcatattgatcaagacgctccatattgatccgttccgcaatggcgccgatcgtcgtttccgtcggcccgtagtgattgatgaagtcggtatgggcgtatacgtcatgaaacttgcggacatcggacgtgatgatcttttctccgccgagcaccactaaacgaagcgagctgaaacggcgttctgacgtaaaacgggctgtattgacgatcatatggaacaatgacggcgtcagtttcatatacgtaatgccgtttttctgtatatactcaccaagctgatcaggcgcggtgtacgtctctttcggcacaatgtgcagctcgccgcccgcctgaagaatcgggaatatggccgtatagccgagatcaaatgcgtaagaagacagcagcacggatttgtcagcttcggtcaaaccggcttcacggctgaaccatgtgacataattgattagattgcggtgttccagctggacgcctttcggtttgcccgttgttcccgaggtataaatgatataggcaagccggtcggcgccggactccgtttcaagccggtcggcgctttcgttctgccattctccgtcttccattacgaccgtttttcctttataaacggcggccgcggtcatgtttctctcattgacgaccagaagcttcgttccgctgtcttcgagagagtagcggattctctcttcaggagtctccggatcaatcgggagaaatgccgctccggctttcatgacgccgagaatcgcggtaatcaagtcggccgaacgatccatcataatggccacgatgtcctcactgcccgttccgcaagcctgaaggtgtcgggcaaaccggttcgagcgttcatcaagctcacgatatgtcagacttgttccgcccgcaaccgccgtgagatcaggcgttttctgcgcttgccgttcaaacagcgaaacaaaagtgccctcaggcagatccgcttccgtccgtttttcatcagaaaggagcgcttcccgctcaggagcggacagcaggcttgcgtcggccagctgaatatccggattttcggcgcaggctttaatcagattgacaaaatgagcgctccagcggcggatggtttcgtccgcaaataaggctttcgcgtaatcaaagctcaatccgacctcttctccgcgctcagccgcttctaaggaaagatcaaatttagcgacatgatgatgcatggagtaagaagaaatctccaaatctccgagccgcagggccgggatctccatgttctgcatattaaataacacgctgaacagcggactccggcttgtgtccctcgttaacggcagtttttcaattaattcttcaagcggatagctttgatgctcaaaagcttgaaggctcgccgttttcacttcatccagaaattgcttgaacgtttttttgccggcaggatgcgaccgaagcgcaactgtgttgacaaacatgcccggcacgtcttggagatcaggatgctgtcttccggccgccggagacccgactatgatgtcttcctgccccgaatatttggacagcagcacttgaaaagcggctaacaagaacatgtacatcgtcgtatccgtatcagccagcagcttcttaatctgcgccgtcacctgtttatcaagcccgaagatgacgcgttccccttcaaaactgcgctcggcaggacgcgggaaatcaagcggcagatccagcaccggcagatcgcctttgaacgtatcaagccagtaagcttcgtgctgatcaagatttgctttttcacgctgccagactgaaaaatccttataatgaatctttggcagctcaagctccgtgccttgataaagcttcgcaagatcaccgatgaaaatgcccattgagcttccgtccgtaataatgtggtgcatgtcaatcagcagaagatgccggtcttctttaagccggatcagcttcgaacggaccagcggcgcacgattgagcgcaaacggcctgataaaggcttttgtcagctcttctgcatcttcttcccggccctcggcggtttcaagctcaaacgacacatttttatgaatggtctgcacgacttctccatctgccatgtcaaacgacgtacgcagtgtctcatgacggttgattaatgcctgcatggcctcttcaagacggtttttgtctactgatccttccagcagaagtacagcagggacgttgtagctcgtgctggcctgtccgagctgattaaggatatacatcctgcgctgtgctgaggaaacaggataatgcttctgataaggcgcttgtcggatcggttcaaactgctgttcctcctcggtctcatgctccaaataatgcgcaagctcctgaatggtcggcttttcaaataacactttaatcggcacttctttttgaaagtgctcctggattttagcggtcatcatcatggcttttaaagaatgtccgccaatcgtgaagaaattgtcagtcacacccgcttttacaccgagaatgccttcccaaatgtccgcgagtttctgctccgcttccgttttcggcgcttcgtattctttttgaacggcttcagcctgaggctcaggcagcgcttttttatcaatctttccgttcgccgtcagcggaaactgattcatctggatgaagtgcgcgggaatcatgtattccggaagtgattccgaaagcgttttgcgcaggtcttccggcgaaagggcttggtctgcggtaaagtaagcgcagatttcattttcatccgctttatttttccggatcacagccgcagattccgtcacattctccgcctggctgattttcgcctcaatttcgccgagctcgattctgaaaccgcggacctttacttggttgtcaattctgccgagaaactcgatcgtgccgtccggaagccacttcgccaagtcccccgtccggtatatcgtttcatccggtctgaacggatcgcggacaaactgcttctccgttaattcaggcagattcacatagcctcttgccactccgcttccgccgacacacagctccccgggcgcgccgatcggctggaggttgcggttttcgtccataatgtacgcagtggaatttccgatcggcttcccgatcgggatcgaaccgtcgtagtcctgatcaatgagaaaactcgtcgaaaacgtcgtattctccgtcggcccgtagccgttccaaagcgacagctccggtgatgccttcctcactttgctgacgatatgcggcacaagcgcatcaccgccgatgatgaggtgccggagcgtgttaaacatgccggcatccttttgggcaagctgattaaacagcggagacgtcagccacatggtcgtgatccgctgctctttcagaaattgggcgaatcgtccggcgtcaagcagcgtctcttttttcaccgggtgcaatgccgctccgttcagcaatgcgccgaagacttcaaaggttccggcatcaaagctgacggctcccgtttgcgccatccggtcttcttcatgaaccggcacgtaattcgaaggtttgacgagcctgatgatatttctgtgttcaatcatgacgcctttcggtttgccggtcgatccggatgtatacatgatatacgccaagtcgttgccgccggccgggagattcaagtctgttccgcttaccgtttcatccgcgctttcattcagcatgacaatcgggacttgcaatgtgcccgcttgttcttgatagtcctgaactgtcagcacgagccgaatcgagctgtctgccgccataaagcggagacggtcctccggaaaagccggatcaatcggcacataggcgccgcctgcttttaggacggcaagcattccgataacggtttccgcagaccggtcgttcataatagcggcggtccggcctttttccagcccgctcttcacaaggtgtctcgccaggcggttggccgcttcgttcacttcacggtaggtccattcgcgtccctcttcttttatcgcgatgcttgcaggcgtccggtttgcctgtgcttcaaacaaacggtgaacggcctcctcttccggaagcgccgttttcgtatcattgaatatctcaacaatctgccgctcttcttcgcctgaaacaaggccgagttcccgcacgggcgcgtcaggcgttccgaccgccgctttcatcatgcaggtcagatggtgcgccgttcgttcgatggcatcatgtgcgaaagccgctccgttgtatttgattttgacggtccacgtttttcccggatacacgatgagattgaaatcaaagctcgtctgctcaaaagcatgttcaactttaatggaaaagccgagtctttcctccatgcccccgttttccagctctttgtccagcggatagttttcaaacgcgaccaaatgattcaagaggctgccgtccagagcggagcgcttttgaatgtcatagagcggcacataatcatagcgctcggcttccacggcgtttttctgaactgccgccatcacgtcagaaaaggctgcatctttgtcaatcttgattctgacaggaatcgtattgatgaacagccccgccatcgtttcaatgccgttgatttctgaaggacggcctgatacgacggtgccgaacaccacatcgtctgtatagttgtatttgctgagcaccgcaccccaaacggcctgaaacaggttaggccccgtgacttgatgccggttggcggtctgctgaatctgcgcgaccagctcttcatcccagacaaaagaatattcttcattttggtagtctttcttttctgatgccagacggcccgggagcaggctcggctgttcgaaatccgccaggcggctgctccaatattgttccgcctcctcataatccctgcctccgagccatttgatatagtcagagtaaggtttgccctggcttcccccggcgggccggccggcacgaagcgcttcatagttttgaaacaggcttttcatcaaaacgcccatactccagccgtccatgacgatatgatgattgctccagacgagatacagttccttctcactgagcctgaacaccgccgctttaaagagaatatccttcgccagatgaaagccctgctgctgcacatcgcgtttatagcgttcaatatattcggtttggcgcgcttcatctaattgactgatatcttcatagtgcaccttcgtcttccgctctgctaatacgacttggcgcggtttttgaagctgctggtgcacgaataccgtacgcaggatgtcatatgtccgaatcagctcattgacacttttttcaaaaagctcaagctgaaagcttccgtgaatcctaagctctaattgtgtgaagtaggaggaagaatgcggatcaagcagcgcatgatacagcattccctcctgcatcggtgtgagtgcatacaccttttgaatcgattttttgctcatatgtcacctctgtcttttctgttagagaatttccattaatttatcaagttcatcaagcgtcagatcatcatcgccaagatcgctaggcgtaagctcaggtccgtcttgggccaggcagtgatctatgattttcaagaggtgccctttaaagctgtcactgaacgattgaatggttttttcatgaaattcgagagaatgataggcaaacgtcatcgtcatctgcccattttctataaatccgacaatatcaagcgcattcggcttctctgtgtcagggctcagcgattgtcctgacggcatcccggatcttgtaaataagccggaatccgacatctcattaaactggcctaagtagttaaagctgatatccggatcaatctcaaatgaaagaccctctttatgctcaggcgccgttacataacgcagaatgccgtagccgactcctttgttcgggatgtgtctgatgtcttctttcatttgtttcagctgatatgaaagatcgtcggcgtgcttcatctcaaggatcatcggatacatgctcgtaaaccatccgaccgtccgggtgatattcaggccgtcaagaatgtcttcgcgcccgtggccttccaaatgaacgccgatcgtgtcttcacccgtccactctttcagcgccagtccgagcgccgtgagcaggatgtcgttcatttccgtatggtaggcttcatgtacgtttgtcgtcagctgttcagtttgttcaggcgtcagagagaaactgaccgttctcgtatgtctcatgcgctgatcgccagactgcctgtctttcggaagctgagtgcatacctctttctcctcaagccccctccagtaatccgcttctttcagaaacgccttcgtatttgcgtattctttgattctctcagcaaattcggcgaatgaatgtgttttcggaggcagcgccggttcattgccttgtttcagctgcgtataaacggacgtgaagtcctccagtaaaatccgccaagatacaccatccacgactaagtgatggattgcgagaagaaggtggtctccatcttcagcccggaagagcccggccttcagcagatgtcctgtttccagtgaaatactgctttgaagacggtctgcttcccgttcgatacggtcctcatgatcttcagcaggtccgttcagctcaaagacgttcagttcaacagacgcatcctcaagccctctgtaatacggtttttgttcacgataaatcatccggagcgcatcatggtgcaccgtcaggacatgtaatgttttttctgttatctccggatcaaagccgtctttcgcatgaagcatgacggattgattccagtggtgtttgtccgtgaagtttttctcaaagaaccagcgctggatcggcgttaactccgcttcgccttcgacaggtccctgatcggcctgcttgccttccgtccgctccacataagagacgagctcttcgatggtcgggtgctggaagagatctttcatttccagcttgtagccgtgctggttcaggcggctcgccatttggatgcctttgatcgagtcgccgccgagggtgaagaaattatcgcttacgccgatctgatcaagaccgagcacttcctcccaaatgtcggaaagcagcgtctccatctccgtttccggcgctttataagcggcgcttcccgcttcaatgtccggttccggcagggcttttttgtcaatctttccgtttgcggtgaccggaagctcgtccatctccacccagaacgccggcaccatgtagtccggaagcgtgtctttcagcgcggctttgagcgcttcaatatcgtcctgccgaggcgcgacataggcgcaaagcgcggtattgcccgctttgtcttccaccgccgtcaccgctgcgtcatgaacgtccgcaagctgggcgaggcggacttcgatttctgaaagctcgatccggtagccccgcactttgacctgctggtcgatacggccgatgtattcgatgccgctctgcgcgttccatttgacgaggtcgccggtccggtacatgcgctcgccgggcacgaacggatctgcggtaaaccgcttcgccgtttcttcctcacggttcaggtatccgcgtgccagaccgcggccggccacgcacaattcaccggcaatgccttccggctgcacctgatcgccgtcgccgagaatataagctctcgtattggcaatcgcccgtccgatcgaaagcgatccttcctcaggattgatgacgccgcttgtcgcgacgacggtgttttccgtcgggccgtagttgttgacgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcctcgaaatagtgatttaagcgggtgatatccagccggatcgcttcgtcaatgacgtgaagttccgcgccgatggtccatgtcgggaacatctcccagatggaggcgtcaaaaccaaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagctgatccgccgttgtttcagtctgcgggttcgcttcatcgttttcatcaagcggcaggctcagaatggagcgtccgccgtcaagcagaatcgtatctcctgtgtagccatccggtacgtccagcgcttcctgtgtgagaagaagcttggcgccgctgtcctgcagaatgtagctgatccgctcttgtgggtagtcggggtcaatcggcacaaatgccgcgcccgctttcaggacgccgagtacgcccgcggccatttccaaggacggtttcgtcaaaatgccgacacgttcgtcagccgtgacgccgcagtctatgagaatgcgcgcgatccggttcgcccttgcgttcagctcgccgtacgtccatttcgcgccgttatatgccgcggccggccggttcgcgtatcgggcggccgtttcttcaaagagacggtgaaccgttttgtcctgcggcacagaaattgtttttcctttccatgcattgaggagggcttgtttttctgtttcattcaccaaggaaagctcagaaagcttcgcagccggattttccgttgcggcttttaacagttgaagccaataatgcttccacgtctctgccgtttccggtttaaacagcgcggtgttatattcaagcacaaacgttaagccttcgtctgtgtcctcagccgtcatcgtcaggtcaaacttggctgtttttctgtcaaacgggtggtgcttcagctcaattccttccatgaccagatcttcagcatttgcattttgcattgagaataccgcatcaaacagcggatttcggctcgtatcacgctgcacctcaaccttttgcagaaggtcttcaagcggataatcctgcgcgtcaaatgcatgtaaagcggtttgtttcacttctttaagatagtccgtgaacgttttgtccgcttccggatacgtacgcagcgcgagtgtattcacaaaaacaccgatgacgtttgcgagatccgcatgtgaccgtcccgcaaccggcgagccgacaatgatgtcatgctgtccgctcagttttgagagaaaggcgctgtacgacgccagcagcaccatgtacatggtagaatccgtttgtttcgcaagactgcgaagagccgacgtctgttcctcagtcagagaaaagaccagcttgtctccttcaaaggtttgcacggccggacggctgtaatcagccggcagcgtcaataccggaagctcgccgtcaagctcccgaagccaatgctcctcctgcttgcggtactgctctgattgaataaatttctgctgccataccgcatagtctttataatgaatccgcagcggctcaagcgtttcgccgccatacaagcgggacagttcatctatcagcacgccgactgaagcgccgtccgaaatgatatggtgcatatcaaacagcagcaggtggtcatgttcagccagcttgaccagccccgttctgacgagaggaagctgatccagacggaacggccggataaagctctgaataatccgttcagcatcttcttcagaggcttcataatattccatgtcgatataagcttccgcccatatacgctgaaccgtttctccatcctttatgtcaaatgtcgttctgaaggcttcatggcgttctgtcagctgtttcatgacggatttcagcttttctgcatcaagctttccttttaaacggagcacagacggcatgttatagcttgtttcagcgccttccagctgctgaagcacgaacatccgcttctgcggtgaagaaaccggatacgtttcccgctccgcagccggtgcgatgctctcagccgccttccgctcagccccttcaatcagctgcgccagcccagcagccgtcggagaagtgaacagatcctttaaggtaagctgcacgccgaatgtcttctggataagggccagcagtttcatccccgctaacgagtggcccccgatctcaaagaactgatcatggacgccgacccgttccatttgcagcacctcagcccaaatatccgccagtttttgttctgtttcattgcgcggcgccgtatatgacacggcattcgctgcggtcacatccggcatcggcagcgcccgcctgtcgatttttccgttccctgtaagaggcagttcatccaattgaataaagacggacggaatcatataagccggaagatccttcgccgtatgctccctcagctcccgggaagatatttccctgaggccgacaaaatacgcgcaaagaagtttgtcacccgcgccctgatccacagcgagcacaatgcattcctgaatctgatcatggctttgaagctgatgctcaatttcgccaagctcaatccgctgaccgcggattttcacctgatggtcgatgcgtccgataaactcgatatcgccattcggaagccatctggccaagtcgcccgttttatacatccgttcaccttccttaaacggatgctttacaaatttttcttccgtcagttcaggacggttgtagtagccttctacgagaccttccccgctgacgcacagctctcccgcgatacccgccggctgaatgcgtccggctgagttcataataaagacttccgtattgctgaccggtttaccgatcggaacggagagcgtatcctcttcaatgacatccaccggatggtatgtcgcaaacaccgtgctttccgacggaccgtacatatgaagcagttttcctttcccgactgccgccagcgcctttttgacatgttctacagacgctctttcgcccccgaacatgattttccgaagcgtcgtcagacaggacggctccatatcaacaagcaggtggaacagggccgtcgtaatcatcagaatgctgacgttctcccgtttgatcacacgggacaggcgcgacatgtccagcaccgtatctttcgggacgatcacaagctttgcaccgtttaacagcgaaccgaacatatcaaacataaaagcgtcaaagacgtagtttgacagaccgagcactgtgtcctcttcagaaacggtcaaatagttcgtgttttttaccgtccgcaaaatgttggcatgtgtgacgatgtttcctttcggcgttcccgtcgtgcctgatgtatacgtgagattggcaatcgttttggaatcaaacggcaatgctggattgcgagagtccttttcatagctcgcctcatcatcagcaagcacaatgacgccttgaaaaccggccttttccgcaagcggcttgaggctttgctgagtcaggagcacattcgccccgctgtcgcggaagaaatgctgaatccgctgaaccggatgctcaggatcaatcggcacataggcggaccccgcttttaacacagccataatggaaacaatcatgtccattgaccgttcacataaaacagccgcggttttcccgccgcctccgaccgaaagaatatgccgcgtaagcctgttggcgcgttcattcagctgctgatacgacagagtttccccttcgaactgaagagccgtccggtcagggttctttcgggcctgttcttcaaagatctgcacgatcgtttgctctttcgggtatgccgtgcgctccggattgaaccgctgtaattggttcaaagcctcccgttcagaaagcagatcatattcgctgattttcgcatccggctgagctgccgcactctccagcagacggacatagtgcgcaagcatgcgatccgcagttgagcgcttaaacagcttcgtgcaataatccaaatcgagcgcaatgccttccgctgtttcccgggcctgcattgtcagatcgaatttagcgatattgaagttggtttcatgaagagacagcgtcaggttgccgatctccggaattccgtccgaagcattttgcagactgaacatcgtgtcaaatatcggatgcctgctcatgtcccggggcacgttcagctcctcggtcagccactcaaacggataatcctgatgggaaaacgcgtccagcacctgtttgcgcacatgacctaacaagccggcaaatgtctgatcctgcttcacggagcttcgcagcgcaagcgtgttgacaaacatcccgataagcccctcggtatcagagtgatttcttcccgctgacggtgttcccacgatgatgtcttcctgtcccgaatacttagaaagcagcgtatagtatgccgataacagcaccatgtaaagggtggctccgtttttctcggcaagcttctgcagccgttcccgcagcattttcggcagcttggcggacacgcggtcaccttcaaagctttgcacctgcggccgcggataatcagggagcagctgaagcaccggcagttcgccgctgaagacttctttccagtacgcccgctccttcttgtagccttctttcgcccgttccgcctgccatacggcataatctttatattgaatgcgcaattcaggcagctgatttccgccgtagatgtcagccagttccttcagcatgatggaaatagacaccccgtcagaaatcaggtgatgcatatcaaacagcagcatatggcgattgtgaccgagcgtttgcaggccgattctgaacagcggcgcctcagataaatcaaaacggcgcacaaagtccttcatgacctgttcattcgttcttccgcgcgcttcgagcatttcaatatgaaacggaacatgttcgtgaaccacctgtctcggcgtgccgtcctccgattgaaacgatgttctgagcgcttcatgcctgctgattaaggcagaaaatgcacgctcgagcttttcaaggtctaaagcgccctcaatcacggccgcagccggcatgttatatccgactcccgcatcttcaaattggctcgcgatataagtccgctgctgagcgagcgaaagcggatagctcgcctgcttctcagccggctcaatcgccctgaatgccggtccttcgtttcggttttccgcataatcggcaagcgccgcaatcgtcggatgctcaaacaagtattgcagcggaatttcaacgcccatttgcttatgaattttcgtcagaagcgtcattgcctttaatgaatgaccgcctgactcgaagaaatgatcataaatgcccgccttgtccattccgaggacttcctgccagatgacggtgagcgtttcctccgtttcgtttctcggcgcggcatattcggatgagctgacagcctgcacatcaagcgcaaacagctttttgcggtccgccttcccgctcggcgtgagcggaatttcgtccgtttttgtaaagtaagcgggcaccatgtaatcaggaaggtgcttggacacatactccctgtactcggcagggtgaaactcggttcctttttcctgaacgatatatgcgcaaacatctaagctgccctgctgatccggccgtgccagcacgacggcctgcgccgcccccggagcttttctgagcaccgtttcaatttctcccagctcaatacggtagccgcggactttcacctgatcatcttcacgtccgatatattcgatcgtcccgtccggcagccagcgcgccatatcacccgtgcggtacatgcggccgcttccgttaaacggatcttgcaaaaacttctctgcggtcaaatccggaagatttaaatagccgcggcctacaccgtcacccgcgatatacagctcaccggccgtgccgtcgggctgaagccgctggtgcttatccaatatatacagacgggcgttgccgagcggttttccgatcggaacgtacgccgcctgttgattcattccgttatcggcggacacctgatgcacggacgcatctacgcacgtttctgtcggcccgtagacattcgtcagacgcggcgccctgcccgattgatgaaagaggttcatcagctgttcagcaacagcggcggacaggccctctcccccaatgagcatgtggcgcaattcaattccgctgacatctcccgccgcaaccatcatctgcagatgcgcaggggttccgtcagtggcttcaattcggttttgacgataatagtccagcagtgccgagccattcgttacagtcgttttcggcacgatataaagcgtctgtcccaaaagaagcgaggcaaaaatctgtttgacggacgcatcaaaatgaaacggagccaaaagcgccattcttaatgtctgctcaccgcattgataaatctcctgctgcagtgattgcaccagatgatgaacttgccggtgctcaatcatcacgcctttcggccgccccgttgtacctgacgtgtagatgatgtaagccagccggtctgattgtgtactgacaccgtccgcagccgtttcaaactgaacagcctcgtcaaaatcaatccgttcggcatccgctgcaggcgcctgtattccggcctctgtcagaacagccttcgctccgctgtcctccaaaatgtactgaatccgatccgccggaaagtcaggatctatcggcacataggcgccgcccgctttcaaaattcccaatattgccgcaataacacgctcagaacggccaagcagcaccgcgacaggagaatcggctgatatcccggctttaagaaggcgtccggcaattcggcctgactgttcatgcaatgtgcgataggacaatgttcggccttcatacaccaccgccggtttgtcagacagtgacttcactttctcttcaaacagccccggtatcgtcatctccccgcggtaattcaccggattaccggaggcccgtgtcagcagccgctctttctcggattcagaaagaagagtaagctcatcaattatgcgatcaggagatgaaatcgcatcttcaatcagcgtgatcaaacgttcagaaacagatacaatctcctctcccttgaatatgtcgctgcgatagtcaaaatcaatcgtcaatttcccagtgtcccatcgttccttcacatgaatcgaaatatcatttgtaccgcttccgctgaaaatagggtctgtcaggaaggacagattctcttttttctgccactgcatcacctggtactccagagccaccgtaaacaatctgctcagcgaacttttcgaagcgcgcaaatcattgacaagcaggttatacggatacttttggtggcggagaattttcatcagatccttcatccggcctttaacgaattccaagaacgactgtcctccgtcaacgcttgtccgcacaggaaccgtagatacgaacatcccgagcatctgcttttctttcgcattcgtccggtttcccataaacgtacccgtgacaacgtcatcccggccggtcactttgtagagataagtgatcaaagctgattggaacagagatagtacgctgactttatgctcctcgcagaatgaatgaatgcggccgtataagtcgtgaggaatttcttgagaaaaccgtttcgcatcaagacccgcatctgcctggctccgtttcagggacacaagctccggcacggtctcgaactgcccgttccaaaaatcccgatcctttttaaaccgcttcgactgcacatattcctgctcagtcagcacatgctcgataaaggaaggaatctccgtctgttccatacttgctccgcccgaaagctccaaataaatatcagtaatcgcattgcccagaatcgtcatggaaatcccgtctgaaataatgtgatgcacattaacgtaaaaccagacctcattttcgctgatggtatacacggaaaaacggaataaatcctgatcatataatgccagaggcttgcttgcctcgtcacgtccccattttgacagctcttccgcagagcagccggcttgcctgatgtctgtatgttcgatagtcagcggacggtaatcgctcacatattgaacgggctccccctcatcatcaagccgcagacggattctcatcgactcataccgccggacgaattcctgtatcgctttctcaacgtaatgagcctgtacgccgtcgtcagaaatgagtttcccgaacccggcaagatttgaaatacttgtgttcggatagaatttttctgtataccagatacgtttttgagcatttgttaaaggataaaaagttatttccatatgtgtgcgcctcccctttttaagataaaattgtcaattctcccttagaaacagcctccctcaatgtccctaactcattatcaagccaaaagaaccacttacctccaaaacgatcccgattcaatcaccgccgaaatccgcaatccactcacccgcacagtccgaaatgcggctcaaatttatgagaaatcaagacaagaatccaatgtttgtaagcaacagggtttacctatttcttcatgaattactatatatctacttacgttcactttatatgaaattattgtttttatcaccgaaaaatgggtgaaaagtttcattcggcacaccgaaaaaaattccgacaattccagagggtattttgcggcatcccgcaatttatttttaaaaatattatttatgtaaaattaaaaatctttaaactatagtataaatctctcgaatatccagttatggcagaatgaaaatagttttcatatatgagctgatggggaaaaaacagcgcaagaaccgaaacaggagatttaatcgttcgcaatatgatttcattaaaccgcaaaaaaagcactctattttacatagagcgcttcaaaaagattcctttattgcagttttatcaatgttgattaattccatatattcttttccccacttatacatggcgtccaaaatcggcataagggtctctccttgctccgttaatgagtactccactttcggagggacgacagggtaaacctccctgtgaacgatcagatcctgctccagctccctgagctgattcacaagaattttgtgcgtaatatccggaattaaagctttcagctcattaaaccgctttgttccttcttttcccaggtgccacataatcagcattttccacttcccgcctatcacggcaagcgtcaattccttttcgcaattaaacgttttctcatccattcggctcacgggccattctccttcctcttactttttgtacgttcatcatctattcatacacgcttacttttttacacaactttcatcagtttatactaccacgcagttttgctgaaacaaagcgcattgcctgcggggacagtatcctcaaagtaactattagacttcaaagtgcgtacttctcaacatgcggggcactctatagaatgtaaatacatgaaaaagaggagtggatataaagtggaattacagctggcattagacttagtgaatatcccggaagcaattgaacttgtgaaagaggtcgaacaatatatagatgttgtagaaatcggcactcccgttgtcattaatgaaggcctgaaagccgtacaggaaatgaaatcagcctttcctcacctgaaagtgcttgccgatcttaaaatcatggatgcaggcggctacgagatcatgaaagcggcagaagcgggcgccgacatcatcaccgttttaggagcgacagacgactcaacgatcaaaggggcggttgccgaagcaaaaaaacagcagaaaaaaattctcgtcgacatgattaacgtaaaaaaccttgaaacacgggcaaaagaaattgaccaactcggtgttgattatatttgtgttcacacaggttatgatcttcaagcagaaggaaagaattcattcgaggaactgacggcgattaaaaaagcggtcaagagcgctaaaaccgcaattgccggaggcattaaacttgatacgcttcctgaagccatcaaacaaaacccagatttaatcattgtcggcggaggcattacgggagctgacaataaagcggatgctgctgctaaaatgaaacagctgatttcacaaggatcatgaaaacgactgaatacttacatgaaatactcaatgaaatatcccgcaccgcagcattaatagccgacagtgaagctgacaagcttgcagatgagattttatcggcagatcaaatcttcacgtccggagcggggcgttccggctttatggctaaagcgttcgccatgaggatgatgcacatcggcctgaacgcttacatcgtcggtgagacgcttacccctcccctccaagaaggcggtctcgtcatcatcggctcaggctcaggcgaaacaaaaagtctgcttcatacagctgaaaaagccaaaagccttaacggcatcatcactgcattaacgattaaccccgattcaagtctcggcaaacttgcggatcttacgataacgattcccggctctcctaaggaagagaccggcggagacagaaagacgattcagccgatgggttctttattcgaacaaactcttctgctgttttacgatgcggttattctaaaaatcatggagaaaaaagaactgaattcagcagacatgtttacaaagcatgcgaatctggaatgatttactgacggccttcttatcagatggccgtctttttatcgtcttgttgcgcacggtcatgcaggccaaggttttcgggtcggacactcgcagacgaagatatcctgccggtgagcttatcgctataataagtcaattgacgatacggccgcaaccgttcatttctgaatagggaaacggcaaaaaacactttctgatcggatatttaatgaataaaattgatttgtgcggatggttttacagatattcagctgaattgcggctgagaaatatattttaacagctttacagccggccgattctgctttattcttggaccagctttacagcaatttaaaactggaggtgattgatactcttgaaaacattaaaagcactgctgcttgttcttatcatcattgccggagcagtcgcggccctgatcaagggtgatcttttctcagataacgagcagaccgttcagaagagtgattacgacaaagtaatcctatttccgtccgatcgatatccggaaacagcaaagcatattaaggacgcgataaaagaagggcattccagcatatgcaccattgacagagacggagtacataagcggcgtgagcaatctcttaaacatgtgcctgtcaaaacgggatacgatagggatgaatggccgatggcggtttgtaaacagggcggaaacaatgcctccgtagaatatatttctccggcagacaaccgcggagccggctcttgggtcggacaccagcttaccaatgatcccgacggaacgagagtattatttaaaatcaagtaaaaaaacaggaggaacagcgcattgaataaatcatggaaaccgcaagaactggccatttcgtatcatcaatttacaatcttccaaaaagattcagaaccgcctgttatcgattggaccgatgaagccattgaaaaaggatatgcggaagctgacggagctgtttcattcgaagcaaggagaaatacgagggcatttatcgtcttcaggcttaacacaagtgaaccggtactatcctatgagaaaaaagcgactgttccctttgaggctgtaaaagatggaattgagattgaaagcgtgatgtcaaagcggcttttctttaatattccgaaaggccgatacagccttacctgttattcagtgcctgccgaaatatccgatcttcatgcggatacgtatattattgatgcagacgcaatgtaaaagaaacccctgagagaatcatatttctctcagggaacttttataaacttttaccgtttgtttcaattacattctggtaccaataaaaactgttttcctgatccgtttcaagtctttttcatcttcttcatctcgattgatatacacaaaaccgtagcgtttttgatagccgttcagccagcttaaacagatccgtgaatgaccagctgcagcagccgatgagatgaactccgtcactaatagcctctctgcacagttcacccatactgaaggtcctttaccgtcttattccaagctccttcaacctgataggcagccgaagctgacccccatagaaatgtatcagggaacagaccctgttttttatgtatcatgtgtttcatcctcctgatgcgtatgatattgatatcatacgttttgaaacgcatttcagagcaatcccgataaaaacaaaaaagcatccggcttgccggatgcttaagaatgatgatgccgcttttccaatttatgaggcggaggcttcgggacaaagccattttgtttcatcatattaaagcgcctgtccatatgctgtttaatatgttctgctttttctttcggcaggaccccgtactcaacatatttggatatgacatgtttgcgtttttcgagcacttctttttcaagtgattcaatttcttttttctgctgttccgtgagtgacattgttgaaggcatttttgtttcggcgtgtgccggcattgtgaaaaccattgctgtaatgaaaaacgcagctaaagacaatgcagcttttttcatgactctttcctcctttaacgtttgttatatgttgctccctcatccattttttatgcaaaaaaagagcgaaattattcgctcttttcaatcgattcgtccggcagtgcgtatgtgacatacgttcccgctacaaaatcgtggattgaccgtttgtcttctctcattccgaccatgaatgcgctcacgatcacaccgattccaaacgtcacgccatatatcaggccgcccacaagcactctcaaaatcatagtaagaaagcctgcctggtttccgtcttttttgacgatgcggataccgcagatctttttgccgataacataaccgttccagtatacagggagcaaaataccataaagagtcaaaatgatgctgatcattgcgctctcattcgggtcttttcctgttgccagcataaaaataatcgccaaaggcactgaagtaattaaatagtcgagtacaacggctcccaatctgatccaaaatcccgccggtctgtaaatattcatcatgtttcccctcgctatggcttcaaaatcactttaatgtcgccatcttcttttttgtcaaatatatcatatgcagcaggagcttccgcaagactcattttgtgtgtaatgatatccgtcggatcaatttcattttgttcaatcatttgatacagcatcggcatcagatgaataacgggtgcctggcccatttttaaagaaacgttgcgtgtaaaaaaatcaccgagcggaaagccgtccgcttcagaaatgtatgcgcccgtgagctgcacggttccaaacttcttaacggcttctgatgctataagaatcgggctgatcgttccgaactgattcggtttttgctctgctttttcttttgaaagcggcgtgccgtccattccgacacaatcaatcactacatccgcgccccctgacgtttgttcatgcagcagtttcccgatctcatcatgttctgaaaaattgaaggtctctgctccgtttatgcgtctcgcatgttcaaggcgatgcgggacttgatcaactgcgataacccgtttagctccttttttccacgcgaatttttgcgccattaagccgatcggacctgatcccaaaataacgactgtatctccttttttcactccgctgtgctgaacgctccaaaaggcggtcggcatgacatctgacagaagcagcacctgctcatcttcaagctcactgtctgccggaaccagaaaagaagagaaatcagcaaaaggaacacgtaaatattcagcctgcccgccgggataattaccgttaaactccgaaaaaccgaataaaccgccggcatctgtatgaggatttggatttgattcatcacactggctttccatctggtgcttgcagtaatgacattctccgcagccgatgttaaaaggaatcacgacacggtcgccttttttcagctttttgacttgactgcccgtttcttcaacgattcccatcggctcatgcccgacaatataacccggatcggcgggtattccgtttttatataaatgaaggtctgaaccgcatatcccggttgcggtgattcgaacgatgacatctctctcatcttgaatggcgggtgccgggacttctttcacttccatatgttcttttccttggtatgtcaatgctttcacacttggtcagctcctttttcatcactccttcccttttcacctgcttctaaacttggccggtatgttattcggcccgctgaatatcccattgaaaaggatcttcaagctgcgaccaatcagaatcgaactcagactgcgtgagcaggcactgatccaattcctttgtaatggcggcttcatctaaatctgttccgataaacaccaagttcgtatgacgatctccgaattggtcgtcccaatcttccagaatctccggttcctgctttttgatctgctcctgctcaagtttcggcattgccgccacccaataagaaacaggctcaatcgaaaccgccggacccgcctgagacatcagcagcgcaaggctgttgcgggttgcgcaccaaacaattccttttgcgcgcacaatgttgtcaggcattgattgatgcagccagctgtcaaaacgaacggtatgaaacggcagacgccgcgagtacacaaacgaagtgatgccgtactcttccgtttccggagtgtgcgcttcatgacctgccgtcagttcctttatccatcctgctgatgaactcgcttcctcaaactcaaataaaccggtattcaatatgcattcggcgggcacttctccgcgaacggaccggatcagtctggcacggggctgtaatgcgcgaagaaccgtttccagctgttcaagctctttttcgcccaccatgtcgcatttatttaaaatgagcacatcacaaaactcaatttggtcaattaataaatcggcaatctcccgttcatcctcttctcccgccgcttccttccggtcaagaaggctgtcaccggactggaaatcatgccagaagcggtttgcatccaccacggtcaccattgtgtccagcctgcagaatgttgtcagatcaatgcccatttcttcatctatataagaaaatgtctgggcaactggaatcggttcgctgatccctgttgattcaatgacaatataatcaaacctgccgtctttcgcgagtttctcaacttcgactaataaatcttcacgcagcgtgcagcagatacagccgttggataattctacaagtttctcatccgtccttgacaaaccgcctccctgcttcaccaagcccgcgtctatatttacttcgctcatgtcattgacgatgacggcaatttttaaaccgttgcggttttgtaaaatatgattcaaaacggtcgtctttccggcaccaagatagccgctcaatactgtaaccggaatttttttcatatcaatagccccctgataaaatagaatgattacgatttatatctcgcaactgccttattttcatcatgatgtacatagttttaaatcgcaatcgttactatttattttgatgtattctccgtttaaaatcaagtaaaagtcagacacatcacacgttgtttgtccccatccattggtctgacacgcaaaacgtcaacgatttaattggtgaagccttggatccggactgtaaaatgcccggttttaagatgtgtgcggtacgaatcatccctatctaattttcataaaatttttagattttttcgtattttttgttacatttcataacatgcatcttaaatatttgtttttgctgtgctacgctgaaaaaaacaaagataaggagcggatcatctgatgggaaaaaaacagctagtccttgttggaaatggaatggccggggtaagagcgattgaagaaatactgcgtgtttcaaaagacgaatttgagattacaatattcggggccgaacctcatcccaactataaccgaatccttctgtcaaaagtgctgcaaggcgataccgacattcaagacattacgttaaacgattggaactggtacaaagaaaacaacattcagctgtataccggtgaaacagtcatcaaagtcgacacggaaaaccaaaccgtcatcaccgatgcagacagaatccagccttacgatgaactcatcctggcgacaggctctgtcccttttatccttccgattccgggcgcagacaaacaaggcgtcacggcattccgagacataaaagataccgacacgatgctcgccgcgtcaaaacaatataaaaaagcagccgtcatcggcggaggactgctgggtttggaagccgcgcgcggactgctgaatctcggcatggacgtgtctgtcatccacctcgccccattcctgatggagcgccagcttgacgcagcggcgggacgcctgctgcaaaacgagttagaaaaacaaggcatgacatttttccttgaaaaacaaaccgaagaaattctcggtactgaccgtgtcgaaggcgtacgctttaaagacggcacaagcatcgaagctgatctggtcgtcatggcggtcggcatccgcccgaatacacagcttggcacagaaagcggcatcccggtaaaccgcggaatcattgtcaacgattatatgcagactgaaattccgcacatttacgcggtcggtgaatgtgccgagcaccgcggaatcgcgtacggtcttgtggcgccgctctatgaacaggcaaaagtgctggccaaacatatttgcggcattgaaacaaaaccgtacgaaggctccgttctctccactcaattaaaggtatcaggcgtcgaggtcttctctgccggcgactttgatgaatcagaggacaaaaaggcaataaaagtgttcgatgaacaggacggcatttataaaaaaatcgtcctgaggggcaatcaaattgtcggcgctgttttgttcggagacagcagcgaaggcaaccgcctgttttctatgattcaaaaagaagcagatatctctgaaacctccaaaatatcaatcttacagcctcttgatcaggaagcaggcgtaagcatgaccgcggcgatgagcgacgatgaaatcatctgcggctgcaacggcgtttcaaaaggtgccattattcaagccattcaggaaaaaggctgcacatcaacggacgaaatcaaagcatgcaccggggcatcccgttcctgcggaggctgtaaaccgctcgtagaagacattcttcaatatacactgggctcagaatttgactcatccgcgcaaaaagaagcgatttgcggctgcacctcactgtcgagagatgaagtcgtagaagaaatcaaagccaaagggctctcacatacgagagaaatcatgaacgtgctcggctggaaaacgccggaaggctgctccaaatgccggcctgccctcaactactacttaggcatgattaatccggctacatacgaggatgacagaacatcccgttttgtgaacgaacggatgcacgccaatattcaaaaagacggaacatactcagtcgttccccggatgtacgggggcgtaaccaactctcaagatctccgcaagatcgccgatgtcgtcgacaaatatgagatcccgctcgttaaaatgaccggcggccagcgaattgatctcatcggcgttaaaaaagaagatctgccgaaagtatgggccgagcttgatatgccgtcaggctacgcgtacggaaaaacactccgcacggtaaaaacgtgcgtaggcgaacaattctgccgcttcggcacacaagactccatggcactgggtattgcgcttgagaaaaaattcgaagggctcaatacgcctcataaggttaaaatggccgtgtccgcctgcccgcggaactgtgcggaatcaggcattaaggaccttggcgttgtcggcatcgacggaggctgggagctttatgtcggcggaaacggcggaacccatttgcgcgccggtgatttgctgatgaaagtaaaaacgaatgaagaagtcttagaatacgcgggtgcttaccttcagtactacagagaaacggcaaactatctggagcggacatccgcatggcttgagcgcgtcggtttatctcatgtccaatccgtattaaacgatccggaaaaacggcaggagctcaacgacagaatgaatgagacactctctgtccacaaagatccgtggcaatacttccttaaagataaaaaagcttctaaagatctattcgaaaatgtcgtcacgacttcataaaacagtaagggggaacggacatggttaataaagatatgacaaaggtttgcataggcaatgtaaacgaattacccgaggagttaggaaaaaccgtatatatagaagataaagagcttgccgtatttaagctttctgacgggagcgtccgcgccgtcgaaaaccgctgtccccataaagagggcgtcctggctgaaggcatcgtcagcggagaatacgtcttctgcccgatgcatgactggaaaatttccttagaagacggaaaagtccaagagccggatcatggctgtgtcaaaacatacgaaacactgatcgaaggagagaatgtatacctcctgtattgatcaaagaccggatcacttttccaagtggtccttcattttttaaattgctgaagggatgacgccatcatgaaaaacggaatcgtatactttgtcggtgccggaccaggagacccggggctgatcaccgtaaaaggaaaacaggctctggagaaagcggatatcattttgtatgaccggctcgcaaacccaaagtttctagaatacgcctcaccggactgccggttcatttattgcggaaagctgcccgaccgccattttatgaaacagtctgagataaatgccctgctgatagaaaaagcggcggagggctacaccgtcgtccgcttgaaaggcggagacccaagtgtgttcggcagggtcggcgaagaggcagaggcgcttcatcagcacggcatccgctacgaaatggtgcccggcatcacctcgggaattgcagcgccgctgtatgcgggagtccccgtcacccatcgtgatttcgcttcgtccttcgcgatgatcaccgctcatgatacatcattgcacggcaggccgaatctcgactgggaagggcttgcccgaagcgttcaaacgcttgtgttttacatgggcgttaaaaatctgtcatttatatgcaggaagcttatggagtacggaaaatccccttccgttcccgtactcgtcattcaatgggggacgtggggacggcagcggagcgttaaaggaacgcttcaggatatccatgaaaaagttcaaagccaaaacatcaccaaccctgccattatcgtcatcggtgatattgtcaattttcaaacacacagctggtttgaaagcaaaccgttcatcggacggcatatcatggtggtcactcatggggatgatgaacatacattgacagacaagctgcgcgagtatggcgccgatgttattgaatggccgaagcggatcgttaaaaaaatgcccgcaaacgaaaacatcctgaaacagatcagcacctttgaacaactatttttcacatcacgccttgcggtatgcgaattctttgacacactggctttcaagcagatcgacatccgccgggtgaccgcaagcctgaatgcagcgactgaagccgcaaagacggaactgacaaaacggggctttctcctatccgaatggcaaaatgattctccgcattctctcattgtagggagccgtcaagcagcagaaaacttgccagactcaaaatcatgcctgttttatatcacccatgaacatatcgcggatgagcgattcacttccatgatcgaacgcacgatcagtgagtcacctctgcaaatgattatctgtacgggcaaagaatccgctcagcatttgatcagcgccggaaaacaaatcggcatatcaccgaacccgagaggaaaccgccctcccgtcatctgcatgggcgaagacctccccgccggctgcgggtttaccgccgtgaaaaatcaggaacagttatttgcgtttatacgaaatgaaatgaaagacatgctcgttcacagctgatacgccggaatgcttttctgacccccggacccagcatcggggggcagcccttttttattgtgtcaccaattttttatgatgagtcgaatacatcgccatctgatccgcatgcgggtccaaataggctttggcgctgttcactgcggtcggcccctccgtgaaaccgccggcaatcagtctgagcttgctttcataatgggcggcgtcaccggcgacaaacacgcccggaagattcgtgcgcatatgcctgtcagctttaatcctgccttcttctatctcaagcccccagtccttcatcggaccgagatcaattttaaacccgtggttgataatgagctcatcaagcttgatgacttcagaaagtccggactcagtttggcaaacggtgacgctctcgatccgttccccggtgccgttgagatgcttcagacgatacggcgcaagcacccgcacggaagaccgcttcattttcgccacgctgctttccaaaccgccaaactcctcacggcggtgcaagacggtaacagacgccgcaatcggttccagctcattcgcccagtcaaccgcggtatctccccctccggaaatcacgacatgcttatctcgaaacgcatcaagcttctccaccttataatgaaggttctttcctgaataacggctcgcatccgcgctgtcaagttcattgacctcaagcgtccccatgccgacggccaaaatcaccgtgcgcgtatagtgcttttccccttcggaactttcgagcacaatggttccgtcttccagccgttcaaatccggccacccgctgattcaacacgatatccggctcaaatgtcgccgcctgctccttcagctgcttaatcagctgttccccggcaatcccgggtattccgccgatatcacggatgattttttcaggaaaaaacatagacacctttcccccgagccgcggcaaaaactcgatcactttcgttttcagctcccgcatcccgcaataaaaagccgcaaacaggccgatcgggcctccgcctataatcgtgacgtcgtacacctcatgattttccgccatcgttctgcctcccgtttatatctatacttcatacttttttaattgagaatcaatatcaatgaaagtataacatatattgaggagcagtgtttattcatttctcatcttgcgggaaaggagtgattcagaagtgaggttctgagattgataagcgggaaggtattaaaactgaaaccagtacggcgactggtttcttttttatctctttttcatcagcatgatatcgagatacagctggcaccttgtcctgaagtcgtttaaattaattgatgtcatgtcaagaatctgtttgatgcggtagttcaatgtgttttgatgaataaaaagctgttctgcggctggttttgttttgcagttattgaggagatagatttctaacgttttcagcagttcggtgctgctttctctgtctttggcttttaataacgctaaatcatcgtttacatattccagtgaggcgtttttttcttcgatgctttcaagatagcggtaaatcccgagcttactgtattcgtacgggatattttcctggtttccggtaatttcggcggcctttataacttcaagggcttctatataacttttgccgagcttcaggatgctgctgtattcattgccgattccgatatagatgggagtggggatcttctgaaagtgaaaatgagtcagcagtttgtggatgaattcagatgctgccgaagtgccggagcttttttgcgagaagcttgcgacgacgatgacaatattggaatcaatggttaagacgtggctgactttatcccgcaaattcaagtacgatttgatattttcctttacatcttcgactgcctccccatccccatttgcggcgtgcaggacgactaccgaaaaaaccgacggcagcacggcgttcatcttttccgcttcccgcctgaactccttttcagaggagaattgctgaaagatcgcccgtttcaccaggtcttccgctctctcttctttttcctgtttcagccggttcgttttgtagatgatttttccgacatggaatgaagtttcatataaaaaatcgagctcctcgtccgtcaagtttcggtcgagctcctgaatccagatgtagcccatcacttcccctttatgttttgcgcttacaaccactctctgattcaatccgatactgtctattttttcgacacggaacggttcaggaacggttttcagcttttcgatcaccccgtccttcagaaacctttcaaaaatctgcacggggcatttttttgagaatatcgtctgctggttggcggagtcgaagtgattaatgtaataagaattataggcaagcaaaaagaaatccgcgctttccagaataacgggcttctgcaattcataactgatgaaatcaattaatttatcaatgtccgtaaatgaaaaaactctctctaaaagctcttccatacctatttctcctatgctctttttatctttatcatactctgaggggtgactttttgtatagaaaaaaattcatatactcccaaaacggaatgatccgaaagcctgtatcgtgaaaagaggaaaaagggcggtcccttcttcctctcgttccttgcttttattgagaaagtgtatcacggtagtcatgaaactgatctgtgacatcttttgacggagcctgtgtcaataagctgacaacaaatacagcggcaaggcttacagcaaagcccggaatgatttcgtacaaaaagtctgaaagactggcattcgcccaaatgattacggtaatcgctcccgcaatcatgccggcgagtgccccccatttcgtcatccgtttccaaaataaactgagcagtacgaccggcccgaatgaagcgccgaatcccgcccatgcatagctgacaagaccaagtatcgtgttgtttttctcccaggcgagcaccaaagcgatgattgacaccgcaagcactgccattctccccagaaatacgagttccttatcagaagctgaacgcctgaacatggacttatacaaatcctctactaaagaactggacgtaacgagcagctgagacgaaatcgtactcataatggccgctaaaatcgcagaaatgagaaatcccgtaataatcgggtggaacagaatgttgccgagctgaataaaaatggtttccggatcagccagcttcaacccgcgctggtggtaatacgcgattcccgcaagacccgtaaacagcgcgccgagtgcagacaaaatcatccatcccattccgatccgtctggcgcgtttgatctctttcacagatgtgatcgccataaaacgcacaataatatgcggctgcccgaaatagccgagcccccacgcaaataaagaaataatgccgaggacggtcgtccctttgaacatattaaacagttccgggttgacggaacggatatcggcaacggtttcccccgggccgcccgtatggaaaatcgtcacaatcggcacaagaataagcgccgcaaacataatgatcccttgaacaaagtccgtccagcttaccgccaaaaagcccccgaacaaggtgtaggcgacaacgacgcctgtcacgacccacagtcccgtgtggtaattcaaccctaaaatgctgttgaataagacacctccggacaccatgccggatgatacgtaaaaagtgaaaaagacgagaatgacgagacccgaaaacagtctgagaagcttcgtatgatcaccgaaacggttttcaaggaaacccggaatggtgatggaattccccgctttttcggtatacgttctcagtctcggcgcgacgaaaagccagttcgcccacgccccgagcacaagtccgatcacaatccaagcgccgcttaatcccgttgagaacatggcgcccggaagccccatcaagagccatccgctcatatccgccgcccccgcgctgagcgctgtgacggcagggcctaaagaacgccccccgagcatgtaatccgtcagatttgacgtccgtctgtaggcaaaataaccgataaacagcatgcccgccatataaatacaaatggaaataatcaactgaatgtttgctatggcatttcctcctccgctttatatgtttatggtgaaatggacacccccgcgaggaggatgcccattcagtccctcttaaaacatttcactgattgttttcgcctgcatgtgaagggccaaataatccgggccgcccgcttttgaatcagtgccggacattttgaagcctccgaacggatggtagccgacaatcgctcccgtacaattgcggttgaagtacaggttgccgacatggaattcctgtttcgcccgttcaatatgtttgcggttatttgtaatgaccgcgcctgtcaaaccgtattcagtattgttggccacttccagtgcttcatcaaagtttgatactttagaaaacgccacgaccggcccgaaaatttcttcctgcatgagtctggctttcggatcaaggtcagcgaagatcgtcggcttgataaagtagccttttgaatcatctccggtgccgccgcttactaaacggccttcttcttttccgatttcaatgtagctcatgatcttgtcgtaagaaccttggtcgatgacaggtcccatatacacgtcagcgctgtcagggcttgccgtcacttttgattcagtgatttcgatgacgcgctctaatacttgatcatacactttttcatggacaactgcacgtgaacctgcagaacatttttgtccagcgaagccgaatgctgatgtaaagatggattgagccgccaattcaatgtccgcgtcctcatcgacaacaaccgtatctttaccgcccatttcagcgataacacgctttaagtgctgctggcccggctgcactttcgccgcgcgttcgaaaattctcgtaccgacttcacgtgatcccgtaaacgtaatgatgcttgttttcgggtgatcgacgagatagtctcccacttccgctccgcttcccggcacaaagttgacaacgcccttcggaagacctgattcctcaagcacttctacgaacttcgccgcgatgaccggtgtcgcgcttgccggtttaagaacgaccgtgttgcccgttacgatcggtgccaccgtcgttcccgccataatcgcaaagaggaagttccatggcggaatgacgaccgttacgccggtcggtgtgtagacatattggttcttctcgccttcgcggctgttgaccggcttgccttttgccaattcaaccatctggcgcgcgtagtattccataaagtcgatggcttccgccgtatccgcatcagcttcattccaaggctttccggcttccttgacgagcagggcggagaattcgtgctttctgcggcggactttggcagccgcgcggaacaaaacggcagctctttcttcaggggatgtgtatctccactcttcgaacgctttcgcagccgcttcaatcgcctgctcagcgtgctcctgggacgcctttgacacttttccgacgacttcttctttgtctgcagggttaatggatacgattttcgcttccgtctctaccttttcaccgttgatgacgagcggataatcttttcccagatactcatttaccgtcgcaagcgctttcttaaattcttcaacgttcgattgatcttggaaattcgtgaatggttcgtgtttataaggtgtagtcattgtcatctctcccttttttacttcttagtcattcctttaaaggcgaatgcgatgtttgaggggcgctcggcgagccgtctcatgaaatagccgtaccagtcatccccgtaaggcaggtagactctcatacggtatccttcttccaccaggctgagctgggtttgcgagcgcatgccgtacagcatctgaaactcaaaacggtcgtttggaatgccgtgctcttcggcaagctgttttgtaaactcgatcattttgtcatcatgcgtggcaactgccgtataatgtccttttaaaagctgtttgcggatgagtcttttataattttcatcgacgtcgcttttttcaggataggccaccttttccgattctttataggcccctttgacaagccgcagaaacggattcagcgggctgaggtcatcaagatccttctccgttctgtacagataagcctgcaccacggtgcttacatattcataccggctccggaagtctttaaagatatccagcgttttctggcatctcgtttcatcttccatgtcaatcgtcaccatgactttatgtttttcagccgtctggaggattttcgtcatattttcatagacgagatcaagatctatatcaagacctaaagacgtcatttttaatgacacttgggaattcagctgttcatcagcaattaaggcgatggtctgcatgcactcctcggtgcgttctttcgcaacgtcaccgttgttgacaaattcccccaaatgatcgacagtaactgacagcccctggctgttcaaatgtcggattgtcgggatagaactgcggaaatccattcctccgatgattttgccggctgccacacggcttccccagcttcgcgccatcttattgagaaagctgctcttggataaaaataagaaaaaatctcttgtaatcacttccaaccttaacaccccgcaatctaagaagtatttgtatgagtctattgtaaatggacaaaacatcctctcacaatattctaaaaatacaaagattctgataaatttttgtggttttaccacaatcagcttcttagatagcaggcggattatgccgaaaaaaggcggacggaaatgacggcaatcgtcaatttccgcctttttccccccacgcctcttcgacggtctgaatcaatagctgattcagttcctccgttatgtcaggtttcggtgttttgatcgttttgacatagtgcccgatgcgttctatttcttcttctataaacgcgtgaatgatcatatttctcggttccggagccagctcctgaccgctttttttccttgtaagcagtgtattgatttcagaaatgagcgcttcatccgtcaataaggcatcggccagtacgggaaatgacatcggcggtacggagccgaacgtttcaatccatctgcaggcaaggagaggacgcaaaacataaaaatactttttaatcttcacttcactgccctgcaattccgttttttcattccgttttgccatattgagataatgataaatgccggcttcaggcgaaaaggcgcggattttcagttttcgaagcttttcagccgctgagaaagcttcataatagatcatctcagaagagagccattccaaaagaggcggatttgattttttaaaaagccgcagcgcttttctcagttcccagccgctgatgtcaagcatgtcatgaatcggctcttctatgacatccctatgcggttcgatcgaaaagtaccattcttttttcggcacatagagaaaccgcacatcgtagtcgctgtcgcttgacggaaatccccatgcgcggctccctgattctacggcgtaaagcaccttgacgccgtgctgtgcttcaattcgttttaattcttcgatgatcctttgttccatctgtatccgtccttttccgtgatcattcctgaaaaaagcccaagtacttgggcttttcgctgtcgtcagcctttcagatgcgctttcagaaaggccagcttttccttatggaaagaaggtatgtattcatgtccgaaataccggtaaaccttcaattctttttccgtttccagatgattgtaagcggcaaacaccgtcgacggcggagtcacgcggtcaatcagcccgatagacatgagcaccggaacttttacgcggtccgccagattcatgatatcaaaataggccagtgtattcatcgcggccttctccgtctcagggctgccgttctttctgaaaaaagagttaatctcaagatacggctcatcaagagcgacatcaatggcccgctcaaaattgcttaaataaggataatcggccgcaaccgctctcggaatgtcagatagtgccgccgcggcgattgaaagtccgcctccctggctccccccgatgacggcgattctcgtctcatccacttcatcaaagccgctgatgacttccaaagcccggacggcgtctaagtacacgccgcggtaataatatgtatctttatctaaaatccctttcgtcatccagccgggaacgtgtccgtgcggtgagacgcttgtatctgtgctgctgtgctggccgcggacaagcatgccgaacgcggcatatccgtgaagcgcccaatttacgatgtcatgtatatctccgtcataactcgcgttgtagccgtgatatttcacgatggccggatgcggtccttgccggtcgggaacggcgtaccatccctcaatttccgccttgccgaagcttcggtatgtcagccggaatactttcacgccgtcagccgggtagctttcagccgtcaattcaggctttgcctcttcctttgcaagctcatgtaatgatgatgcccaaaaatccgaaaagtcatgaggagcggttttatttggtttataggtttgcagttggtcgagcggcaagtcgtataattgcatatccgattattctcctttgttttataagatttaattttctgactctatcttaacacgattttacactcattttctaaacattttaataaacgtttgtttaaaagaaaacaaaaaagccgtacgctcacagcgtcacggctctttttacatcggctgatacagatcccagccgatttttaacgtttctacgatataatcggcgatttcttctggttccagattatccgtcgccacttttgaattatgtttatcatagatgctttggcgctcgttaaagagctgctgcatttcatccatggaacggttatgcagaacgggacggctttcaatcagcaggtcagcccgctgcttccaattctcccatgataaatcaagatggagcacgagacagttttcgaggcagcactgtctgattgcctcttgtttaaacgaaccgcccccaagcgacacgatcttgaatttcgtattgcggcagatatctaatatatagtccttttcagtttgacggaaaaaggcttcaccttttttctcaaacatttcagggatggacatattgaaatctttctcaatctgcaaatcaatatcaatgaagtctctgtataatttcttagcgaccagctggccgattgttgtctttccgacacccatgaatccgatcagtacgatgtttctttctcttacgggaatggcacgttttgcgttcatcttcggcgaaatcctcctaagaaatgaaaaagttatgtttattatatgataacccaatattgaaatatagagataatgcaataaaagaaaacccatcctttataagaagagatgagtttttctttctatcggagcgtaatgcgttccacctttccgacaatgaaaatataagaaaatgccccgataaatgcgacagcgccgacaaacagaatcgctccgttatatgaaccggtcgcagaaacgataaacccgatgataagcggggtgataatgccggccatattggcgaaaaagttaaacacgcctcctgccaatccgattgtttcgcttggcgccacctcactcagcatcgtccaggatatattggacatgccctgcgcaaaagaagcaatggataagatcgtcaaaaccgcaggagcagaatccgtaacattcgcgagcacgatggagcctgtcagcagaagaccgaggatgacgggggttttccgggcaacgttcaccgacacgccccgtttcatcattccgtcagaccaatatccgccgaacaatacgccgaaaaaggcggcgatatacgggattgatgcggcgaagccgacttttaagaatgccatgtgctttgcctccgccagataagtcggaaaccatgtcaaaaagaagaacagcgtggaggctacggcgaattggccgatatacaagccgacaagcttgcggtatttaagaagctggacgaaatcccgccacgtgatcctgccggctgattcagacacctctgtcagtccgccgccttctctaatataatcaagctcttcccggttcactttccggtaccgattcggctcgtgatacattttgaaccagaaaacggagaaaacaagcccgagcacccctgaggaaataaagacggcgcgccagtcaaatgccgttaacacccagaataaaaccggtgtggcgaacgccagtcccacatattcccccgccgtataaacacccgtggcaaaggcgcgttcccgccttggaaaccatgtcgtgacaatccgattgtttgccggaaacgcaggcgattcagccagcccgataatcaggcggcagccgaataaaaatccgaaactggctgcaaaagcctgcactccggtgaaaacagaccagatcattaaagaaacgccgtacgtccgttttgacccgaatttgtccaaaatgagcccgccgggaatctgcatacccgtataggtccagctgaatgcggaaaagacgacgcccaaaagcgcggggcttatgttcagcgatgtctgaatggacggggcggcgatggatacactggcacggtctatataattaatcgcagtgataaaaaacaaaagaaacagtatcacataacgagcgcgagtcggtttattgcggacgggactgaagtccgtcagctccgtttcatttttcaatggcttctccccccttactcgaatgaaattaattgtacaacacttcggtcaattatttaatactttgacgcaaaaaagcgctaaacaatttgtgcgccgcactgacactccgcttataaaagtgtctgcccttttcacctgtttatccgtatctcacccggggaaaagtacacatatgatagacagttacgggaggattaccgatgaaactgagtttttgcacgacaggatttaaaaaaaagcatattttcgacatcatttctttcgcgaaggagcactcctttgacggaatcgaactgtggtacggacacgctaaacaatatatagaggaaatcggcccgctcgacaggcttgatcagcagcttcaggaggaaggcctcggggtgcctgccgtcagtttgtacactgacttcgccgctcaggatgaaaggcaggcgttaaaggatgttcaaggggcattaagcgcggcacgacagctgcacagccccttgatcagagtctttgccggcaatcttccttcgcatcggacgtcaccggaaaagtggcaacgtgcggttgatcaatttcagcaggcggcacggctcgcagatgactatgaagtcgatatcgggcttgagattcattacgatacgtacgcggatacaccggaggcggcactggcatttttggaggatgtcggacatccgcgggtccgcaccatttttgacggctccaacctacacgtcaatcacgttgaccaaatgtccgctttagaaaagctgtatcataccgtcagccatattcatctgaaaaactatcactggaattttgacaactggtatctcagcaagccaactccgattttccaaggagatctcgatcaaaaagcatttttaaaagagctgatgaacagacaatatgacggttttgtttctcttgagtattttggagaacatgcctttacgcatataaaggaatcgctccgggaatatacgtctgttttttcccgctgactcttcgatcgaagggtcttttttttgtatcatatagaaaaagggggatatcatgatgatcatttggataaatggggctttcggttccggaaaaacacaaacagcgtttgaactgcacagaagactgaaaccgtcttacgtatatgatcctgaaaagatggggtttgcgatgcgttcgatgataccgccggatatcgctgaagatgactttcaaagctaccctctgtggcgggaattcaattacagcatgctttcctatttgtcagatacatatcagggcatcatcattgtgcccatgaccattacgaacgatcaatacttccatgacattatcagcaggctgagacaggatggccggaccattcaccactttaccctgctggcttcaaaggaaacattgctgaaacgcctgcgcaccagagcggaaggaaaaaactcctgggccgcaaaacaaatcgaccgctgtatcaacagcctgtctgatagcctcttcgcagaacatctccatacagaccaaatgtctattcagcaggccgcagaaacgatcgctgcccaagcaaatctgcctcttgagcctgattcgagaggcagccttcgaagatttaccgacaaattaatggtgaagctgaatcatatccgtatcaaataaaaaagcgttttgaaaacatgtccctgacccatgcaaatggatcaataaataaaaagtccctccgaagggatgtttttttcaatttaagaaaaaaattttagaaataaaggaggaattatatggataatcgtctaattattaacactgtaatacatttcatttgaaaagggagtgttcgaaatgaaattcaaaaaagtgttaaccggttctgcgctgtctcttgccttactgatgtctgccgctcctgcctttgccgcatcaccaacagcatccccatccgtggaaaatagcccaatctcaacgaaagcagatgccggcattaatgccatcaagcccgttccaagccctaacggtattttcgctgcttctttcgaactgaatggtacaacatggatttttaaatacaaatactatgacagcagcaaagggtattgggtagggatttatgaaagtgtagataaataaaaatgaaataaacaaaaaacctccctttcaaaagggaggtttttttcattctatttccaccaatcatcaaacatcgatgccggcacctggcgcttgtgctccgtactgaggtagcgtttttccagcgcttcaatcacttcggaagaaacatccttgccttctaaataatcatcaatgtcattgtatgtgatgccgagctcggtctcatccgtctgctgcggtttttcatcgagcagatcggccgtcggtaatttcaaatacaggcgttccggcgcgccgagttcttctaataaacgtctgccctggcgtttcgttaatccggtcagcggcagcagatcagctccgccgtcaccgtatttcgtgaagaaaccggtcaccgcctcggccgcatggtcggttccgatgacaagcagcccctcttgtccgccgatggcatattgagcgatcattctcattctggcttttacatttcctttgttaaagtcagacagctgatcgcccgtgtcttttttatactgatcagcgaacgcgctgacagcggacttaatatcaaatgtccatgatttatcaggtttaatgaatttgagcgccaattgggcgtcatcctcatcttgctgtgtgccgtgcggaaggcggacggcgataaattcagcgtttccgccttcttctctgatgctttcagccgccaattgggcgaggcgtcccgcaagcgtggaatcctgcccccgctgatgccgagaacaaagcctttggcacctgtttttttcaaatattgtttcagaaagttcactctgtcctcaatttcttgtttcggatcaattgagggttttacatgaagatcattcataatttgtttctggatgctcatcccaatcactcctcctgcattgtttctttatgattcatttcccgttcatactgaaaatgaatcatgccactatgtacgactctttgttaaatatagcacaggtgcagtttttaagtgaaccaaatacaccgggatcagctgatttccacccgcagcgccgtgatgctgtccccgttgcatttccctttttcgatcggacaggatgaaaacgcgacgacgagatccatttccgcacggagccgtacataatcacccgcgtcagaaagaggggtttcgactgataagttccccttctcatcgagcaccgtgttcataaagatggcaaatgggtaatgcatatgcggccgcggcaccccgaacggttcaagcgccccgctcatattgtcatagcacgtatcctggagctcgtccttatgctttccgtataaaagcctgttcatatccggacggcaggcgggaagcagcaagtcgtgcttgccgactgtatcctcaatcagcgtcagcatcggcttgtataaatttgaataaatatgatcacctgtttttacatgaatggactggttggcatcgatcgtcgcgccctgatcaagatgttcataaaagtccttggcatgatacgccgtaaaatcagccacctgctgcccttccacatcgactacttttataatctgccctttgtgaaccttcaggccgagcccttttttcggcggtacgataaattgctgtgtcatcagactgctcctttttttcttctattatgaaccccggccgtttgtttcatgtaaagcaatttattggatgtatattccccttctgacggccgcaatctaagctttgataaaggggttgaacttcatgagtaaatcacaggaccagcctaaagggaatctcgcttggtggcagctctccttaatcggtgtcggctgcacaatcgggacgggcttttttctcgggtccagcatcgctattgtcaaaagcggatattccgcgctgatctcatttcttattgccgggcttggcacctattttgtctttgagcagctcgcgaagctctcggccaaacagcccgaaaaggggtctttttgcgcttatgcgagaaaggctttcggcacttgggccggtttcagcaacggatgggtgtactggtcgtccgagatgctgatcacgggaagccagctgacagcgatctcgctgtttacgaagcattggtttccgaatgtgccgctgtggattttcgcctccatctatgcggtgctcggtcttttgattatatttacggggctgtccgtttttcaaaaaacggaaaatgtgctcgctgttgtcaagacggcggcgattgttatgtttatcgtcatcgccatattggcgctgtgcggtatattttctcataaaccggatgtgcaggtgccgaacgaatcaaaggatttgttcccgcacggagcgatggggttatggacgggattgatttatgcgttttacgccttcggaggaattgaagtcttggggctgatgaccgtgcatttgaaaaagccggaggaagcctcaaaatcaggccggctgatgcttgccgttcttgcggtgatttacgtcatttctctcggcctggcgctgctgttagtgccgctgggcaaattcaccgaacaggacagcccgtttattacatcgctgaagggttttcatttagatatcattcttgatatttttaacgggatttttattattgcgggattttccacgctcgtcgcctcgctgtttgcggtgacgacattgctttgtacaatggctgatgacggagatgcgccgaaatgcttcagattaaaggaaaacaaaaaaatctgctggcccgcgctcggattgacgtttgccggactcatcgtctccatcatcctgtcattggtgctgccgaaaaacatatatgaacacatgacaaccgcggcgggcctcatgcttctttatacgtggctgttcattttgttctcgggcaagaaactgcttgaaacgacaaagatgggaaccgtacagattgttatcgcccttgtgctgattgtcgcggccgtctccgggacgctgtttgagaaatcgagccggcccggttttctggtcagcctttgttttctcgccgtcattgcgatcgtgacatggatcgtacaaaaaaagcagggacacagccctgccggatcatagcttatttcgtcggtttaaacagtctcttcaaataagaaaagggacactttgacacttgggtctcatcatcacggaggaaatattgcttccattctaaattgtcttttcctccgtaccaccccaatcggggatgaagaggggcttcatcatacgcctctaagcgttttctgatcagccggctcatgtttcgtccgaacgcggttgaatcatttaatccttcaaaaacccatctcggctgaaacgccagcataaaaaacgggaagcttctgctttgtctcgcttcatgcgcaggcgtcgcgcacagaataaaatacggctcgccgtcaaagcagaactcccatttataatgttcagggtcttccggtatgtcttccggccagtctttcgggtcgcagccgctcagccggtttaaaaaagaccagaacagctcttcatacgcctcaacggaataatgctcagctaaatcctcaggcgtatcaaaaatcacaagcagcgacgcgtattttccggtattccttgagatctttccgtactcggacagcagcatccccacttcctccggggttccctcttcgcggggatcacccgcaaaggatatccggagctgatctgtcaaaaatccctgacgtccgggaatgcacggaaacgtatccgctttatcgcctactttttctgatagaagctcaaaagcgattctctgccaatttggcagatccaataacttttcctcaaggcaactttttgtgtacagcccgcttgccatcggcccacctccagtatcgtcaggatacgttatgatggagacaggcgataggtgacagtccttctatttatgagatgagcatttgaatcccctgccagccgaaataaaatccgaaaacgatcaaagacacacccgccgctcccgtcagccagcgaagcgctgtttcatgaagaagatttctgaaagtgctcgcagcgaccgccatgcagaaatcccagatcaaaatgccgagaagaatgccggagctgtaaatcaaaagctgatttgcatcgaaggattcagcggttttggcgagaatgctcccgtatatgccgagccagaataaaatgctcagcggattggaaagagaaataaaaaaccccgcgccgaaagttttgtaaaaagccggttttccttttccgcttctgacattcatggcttcccttatattttttaacgtttcgactcccgtgtaggtcagcacgaaaaaaccgaagagccacaaaaacgtttttacaaaaggagcggtcaaaaattgagacagcccgaaatagatcaaaatcatatacagcccgtccgcggccatggcgccgagaccgaaaatccatgcatgccaaaagccgtttttgatgcctttgtcaatttgcgccgcattgaccgggccgacaggtgctgacaatgacagcccgagaacgatgtagcttaaaaagatgttcattggcttccccctcattcatgcaacttgtacaagttattcatgaatgggccgtgctatgatacattattttaatttctcaagctcgtcttccatcatgtccgtcgcttttcctaaaaaatcgaatatcagccgcagttcttcttctttatattgccggcaaaggctgatcgtggactgggataaggagctgaataattgcttcacattcgcttttccggctgtcagcggcacgatgatcacccgccgtttgtcttcggggtcttttttcctcatgacatatcccgctttttcgagccggtcaatgagcgccgttaccgaacctgtgctgaggccggtttttttcccgagctcgcctgcggtcatcgggcctgcttcatttaagatatcagctgatttcaaatcggtcggaaacagaccgagagattgagcggccgcctgatgaaacaggatcgtccttgtggccatcttccggaataactgtatggcggtttcctccgtctcgcttctggtatttcttgttgacaactgacaggcctccctataaaatcaatttatcttgacgatcaagataattttcggcaaatctaatatgatcatagcaaatttaatgatcaaaagtaagtatgggaggaaaaagcatggaacaaacagccgcgaaggacgcctcgacgaagtttgtcgtcatcggtcttttgctgggcattttaatgtcggctatggataatacaatcgttgccactgcgatgggaaatatcgtggcggacctcggaagtttcgataagttcgcgtgggtgacggcatcatacatggtagccgttatggccggtatgccgatttacggaaaactgtccgatatgtacggacgcaagcgtttctttttattcggtcttattcttttcttaatcggatctgcattatgcggaatcgctcaaacaatggatcagctcattatttaccgcgtcattcagggaatcggcggaggtgcgctgatgccgatcgccttcacgatcatttttgatttatttccgccggaaaaacgcggaaaaatgtcgggcatgttcggtgccgttttcggcctttccagcgttctcgggccgcttttaggcgcgctcattaccgactccatcagctggcactgggtgttttatatcaacgtgccgatcggtattttatcattgtttttcattcttcgttattataaagaatcccttgaacacaagaagcagaaaatcgactgggccggcgcgattacgctggtggtttccattgtcggtctgatgttcgctcttgagctcggcggaaaaacgtatgattggaactccgttcagatcatcggtctgttcgctgtgttcgccgtgttctttatcgccttttttatcgtggaaagaaaagcggaagaaccgattatctcattttggatgtttaaaaaccgtttatttgccacggcacagattctggcgttcctttacggagccacatttgtgattttagcggtatttatcccgattttcgttcaggctgtgtacggcagcaccgcgacgagcgcgggctttattttgacaccgatgatgatcggttctgttatcggaagtatgatcggcggaattttccagacgaaagtgcggttccgtaatttgatgctgatttccgtggtcgctttctttatcggaatgctgctgctttccaatatgactccggatacggcgcgtacgatgctgacggtattcatgctgatctcaggattcggcgtcggcttcaacttctcactgctgccggctgcgtccatgaacgatctggagccgcgttaccgcggaagcgccaactcaacaaactcgtttttgagatcattcggtatgacgctcggtgtgacgattttcgggaccatccagacgaatgtgtttaccaacaagctcacagattcattcagcggcatgaaaggagcgggcggcgcgatgcagaacatcggaaatccgcaggagattttccaggccggcacgcgcgcccatattccgccgcacattctggatcgcattattgacgccatgtcgcaaagcatcacatatgtattcacgcttgcgctggcgccgatcgtcattgcggccgttaccattttgtttatgggaaaagcgagagtaaaaacctctcaggaaatggcgaaaaaagcgaattaaaaaaagcagtacatggcgtttgtcatgtactgcttttttgtttactccgcgaaatgcggagcgagaatgtctttcagcacgtttgcgctatggttgaattgacgctgttctgtttcattcagctcaagttccgtcacaccggcgatgccgttccgattgacgacagccggaatgccgataaagacgtcgtttacaccgtattgcccgtccagatatgtgctgacggttaaaatactgttttcattacgcaaaatcgcttttgtgatgcgggcgaggctcatcgccactccgtaatatgtcgcgccttttttctcgataatatggtaggcggcgtttttcacatcgtccacgatctgatccagctcgtcctgtttgtaagctgcatttttctccagcaattgctgcaccggcactccgccgatattggcgtgactccatacaggaagctcggtatcgccgtgctcgccgataatgtgggcgtgtacgttttgcggagcggcgccgaaatattcactcagcatataacggaatcgcgcagaatccagtgtcgtgccgctgccgatgacgcgttctttcggcagaccgctgaatgtccatgtcgcataagtgagaatgtcgaccgggtttgtggcaacgaggaagatgccgtcaaatccgcttgccattacttcaccgacaatgcttttaaaaatggcgagatttttttcgaccagctcaagtctcgtttcgcccggtttttgattggctccggcacagatgcatacgatatcggcatccttgcaatcttcatatgttccgtaagacgttttcaccggatgaggtgcaaatgcctttccgtgatttaaatccatgacatcgcccatggctttttctctatttacatcaatgatcacaagctcatctgtgatcccttggttaattaacgcaaatgcataactgcttccaacaaaacctgctccgattaatgctactttgttcactcgttcgttcatcatgtatgctcatcctccagtgtttcgtggtgtctgtttttaacttgtgaagtatttcacatttatattgtgcaacacttcacaaacttttgcaagagaaaagtttgatttttggacaaaaaatatcgatgatggtttccagattgttgacaacatcctaaaacggaaccgttttaggatgttgtatcttttcagcgtgattgaagacgtgctgtccttttcccagaagcgagggtttgccggcacgctgatgtgatgatagccctatccattaatgcggaagataaccgtttaaaccggagttgttatacaaaccattctgcacataatcaaatccgggctggttctgcccgggcacttgggcgctgccattgttaaaaatcactttggcattggccgtatccgcattcgcaggcagcgtcagcgtgtaaattccatttgcattcttagtcattgctttccccggccacgatccggttaattctatggccctgcctccatcatgtttgtaaatataagcatttacctggccccaatgatccggattttgatagccaatgatgttggtttgggcctggtcttttttgacaaacgtgtattcttgagttctctctgcaccctcgccgttcgttccggttaacctgatgttgtatgtcgtgccgattggatctcctttcccgatcgttaatcggtctccatccttaaatgctgtctgctgcccattattgatttggtaaacggcttttgctgttttcgcatttgcacgcagggtgaccgtcagctgatcattgaaagaatggactgcccccgtttggtaattctcaagaaagacatgaggcgcatttccaatatcatcagaataaagaacagccgcggatctggcattgatcgtacctgtcagtttgccgttcgctacttgaaatgaaccggcgccggccctattatcatacctgccgtcaggcaatttcgttgaagtattgacggtgacagaagacgatcccgcattagccagcacaacgccttttgagccgcgctgattcataaatatttgattgttcccattcggattcgagagttcctcaggctgcccggccattacattgtgaaattgattgaccgcagtgatcgcctgatctttaaataaggcgctcccgcgatctcctatttgactttttccgggaaatcgcaccccatttcctccgccctcaggtctggaaaagaaaagaggcgtgcttcctgagcgggaaccaatcactgcccagcctaaacggatatcgtcatcactcatccatgtggactcttcctcatcattggcatacgtatcatgtgattccacccatgtgaccaacttgtccgcagacacgtcagatgcataatgggagatattcgacacactcagattacggttctttaaagcggatctgatggaatgcccatagttagaagccgtcacattcatataattcgcataagcagtatctctggacgcgctgtcttgcaggatttctccgtattggaactccgccgatgtatttgtgatattcggccaaaatcggctgccgtaattcccatcatccggaagctctatatgcttggcggcatcatagcggaacccgtccgctccgtcattcaatgctctttccaagaaacgtttcagataggtttgcacctcagtattctgtgtattccaatcatacagcccaagcaatgaattttgagtgacgtcccacctgtccgaccaatttttaatttgtgtgtttccatgggtccagtttggaatacgcttaatctcgtcagaaatcgcggcgtaatcgctggtggtatgattgataaccgcatcaacaatgacttttacgccatatttttccgcggctgcacacatgtccttaaattcttgttcagtgcctaagtaacggttgccgatttggtacgatgtcggctgatacagccagtaccagttcctcatgcttttatctccttggttcccttcctttacttggttaatcggagacgtctgaatggctgcatagcccgcatcacgaatctctttcatattttgtgttaacgtattgaacgaccaattccaggcatgaaggatggtcccgtttttgaccgatgacgcggccacctcattcgatttgtttgcagtttcagcgtttgcagccgccgggcctgacaaaaccaaatgaaacagcaataaaaatccggcgaataacggcagtaaagaggttttgaatcgtttttcaaacatttttgacactccttatttcatttttgaagactgactgcggagtcaaaaattcctcttactctttcttcagctcctttcaactgttgtgaagactggagaattctgttaacgcttacatttcaacttatcacactctctctatcaaagcaacgcggcagagtgaattcaaatctatattcctatcaattaaaaagacttcccgctttcaaacaaaaaaagaaaccacctgtcaagatgatttcttttttatttcttttatcgctcttctgtaagacagcttcacaatgacataccgaagcagaaacagaatgcctccgcagacgataaaaagaaagatcattttcagccaagcaaagaatgtatggggaaaccccctgtcgtacatcgtaagcgccgccaccgcaaaagtgactgctattgaatctatccgctgctgcttcacccgctttttcagttcttctttggtgtctattctcggcatgagcattcccgacgctcccgccctgatgcaataataaacaattataatgaagaaaaccgccaagctcccggcccattccctaaacggacagttcagaacaagtccgcgtacgatgatgtcaagcaaagacagtgtgcccacaagcattccgacttctgaccaaatcattcgttctttctctttcacactctcactctttccattcacgtttgaaagtctgttccgacgctgattcatgacttcctcccgtactattaagaatggcttacaactcccattatatcttgccgattcataatgataaaccgaaatatcattgacaaaaatgttaataagggccccaattgatcaggacgcctatgcagataaacacaaggccgatgacaaaccaaatcagcgccagcggaatcatgaagcgaagccactttacgtacggaatgccgctggcagccagtacggccatcagaacgccggaagtcggattgacacagtttacgacgccttccccaagcatgaccgcttcaaccgcgacctgtctcgtgatgcccatcagatcggcaagcggcgccaaaatcggaataaatacgaccgcctcccctgagcccgatgatatcagaaaatgaagcagggcgctggaaatatacattccgattgcgcctgccatcgggctgaaaccgtgcagcagtgacgcaagtccattgactaccgtatcaagcagctttccgtgttccagaataacggaaatgcttctcgccattccgacgatcagcgcgccgtaaacgagcccctgacagcctgtaataaacgtttttgcgatatcatttgccgccattcccgcaatcaggcctgacacgattgagataaaaatgaacacggcggccatctctgaatcagaccagtcaagagtaagcgcgccgtataaaaagccggcaagcgacaaagccgcgacagccagaatcaatttatggcggacggtaaacgggactggcttgtcctccggatctgaagcctgcgggattgaacctgctgccggaaaccaatcgttccccagcagactggcgtcctttgcttttctgagccttctcgtataccgataaatatataaaatagatgatagcagaaaacaaatgtagacggcaatccgcaggccgatgccggaaaacagcggcagctccgcgatgctttgtgataacccgagcggtgaaggtgataaaatcgtcgcgttaaacccggcataacagccgatataaatgacggccgctccggccacggcatcccatttcagcgaacgggcgacgatcaggccgatcggaataaaaccgatcacggaattaacgacgatgccggttgtgccgaggatcgaaaatagagatccgacaattgcaataaacagcagctgtttggtgcggaacgtactgatgacattactgatcaatccattgatggcgcccgttttctccaaaatcgcaatggtgccgcccgtaaacaggattaaaaaaataatcggcgcggaacttgtcatcccttcctgaatcgcggtaaaaaaagcgatcgggctgacaggagactggtctaaagaatgataacttcccgggacggcggacgtcacactgccctttgtcaccctgtcaaattcccccgcaggaacgatgtatgatgctatcgcgcatagtaaagcgacaatgaacagcagcacataagcatcaggcatcacaaacaatttcttctttttcaatacaggttcggccttcggcacagccataacatcaccatcccgctttgaatttataaactattcagaaaatacagatatgtgctatattatatacagaccgattgcctgttttcaatatcaaaaataaaaaacagacagcttttgaaggaggacttacggcatgaacagactcacagagcatgaaaagcaagtcattatggacatttttgaccacctgcacgccaatcccgaagtaagctggaaagaatatcaaacaactgaatatctgactgaaaaactgaaagaggccggctgccgaatccgtacgtttgatgattgcaccggtgttgtcggcgaaatcggagaaggctcgcccgttgtggctgtccgggcggatattgacgcgctgtggcaggaagtggacggtgtctttcaggcgaaccattcatgcggacatgattcacatatgacgatggcgctcggcacgatgatgcttttaaagagtcagccgaagcttccgaagggcaccatccgctttatttttcagccggctgaagaaaaaggcggcggagcgctgaaaatgattgaaaaaggcgtactggatgatgttgacttcttatacggcgtgcacgtgcgccccgtacaggaaacggcaaacggccgatgcgcaccgtccattctgcatggctcaagccggcatatagaaggcctgattatcggagaagaagcccacggcgcgagaccgcatctcgggcttaacagtatcgaaatcgccgctcttctcgtccaaaaactcagcttcattcatcttgatcccggcatcccgcattccgtgaagatgacaaagcttcaggcaggcggagaaagttccaatatcattccgggaaaagcatcgttcagccttgatctccgcgcacaaaccaatgccgccatggagaaattaaccgccgaaaccgaaagagcctgtgaggcggcggctgccgcattcggcgcaaaaatcgaactgcaaaaagaacacagcctcccggcagccgagcgaaacaaggaggcggaagccatcatgacatctgcgatcagcagcattctcggagaagaacatgtggatgaacctcttgtgacaaccggaggagaggattttcacttttacgggttaaaggtgccgaacttgaaaacgacgatgctcggcctaggatgcggtctggagcctggacttcaccatccccaaatgacatttgaccgaagcgccatctttactggcgctgagatattaacggccgccgtcctcaaatcgtttgaagcataaaaaaaagcagcccgttacagggctgcttttcttcattacttcttcagatcttcaattgaattgacgtttttcatgtactgaggaacgaccagacccatcttgacgcctgtcagactcgttcctacatcttcatatttgcctttatatttagacgcatatgccttatgggtattcggaagccaagcagacaatgacgcatccgcgctgcctgtcgcaatcgcagtccacatcggtcctgcctccacttgcgtcagcttcacgtcatagccgaggtcttgaaatacttttccgattacattcgtacttgcgatttcactgtcccatgccacataagccaggttgattttatcccctttgactttatgggcgccttttgtccattgagccacttggtctttatgttttttcacatattcagctgcggctttggccggcttttcgccttcctcaacggcaatcatgacttctcccatatcgtcctgcgtccatttgaactggctgagaactttggccgcgttaggctgttccttactgaagccggttcttgtaatcgtatgaatctgctcggcagttccgtacgtttttttcggatcatcaaggaacttcagcttgtatctggagaacatccagtgcggcgtccagcccgttacgatgatcggctttttccggtcatatgatttcttcaatgtcgccgtcatggcggcacttgacgccgtgatgacattccagtctttcaatccgtaatccttcacggcctcatccgtcagggccatgatccccgatcccggatcgataccgataatggttttgttcacctggtccgcagccgttgccttatcatcagtctgcgaaccgcaggcagccaaagaaagagccagcgcagcggtaacgccgacaccgatgattttcttaagcatcaggcattccccctgctcttcttcttcactttaatgttttgcgtgatacggtcgagtgtaatcgctacgataacgatcgcgatacccgcttccactccgacaccggttttcaactgtgtcacggcgctgtatacttcagaaccgaggcccggcgcaccgaccatggccgcgataacgaccattgacaaagcaagcatgatgctttggttaataccggcaagaattgtttttgtggcaagcggaagctgcaccttgaacagacgctgagacgtcgttgaaccgaatgcttccgtcgcttcaatcagatcagccggaacctgtttaataccgagaactgtcatgcggatcgtcggaggcatcgcgaaaataacagatgccacaacgcctggcacaaccccgatattaaagaagaaaattgcaggcagcaggtatacgaaagccggcatggtctgcattaaatccagaatcggtgtgacaatgcggcggactgtttctttctgagacgcccatatgccgatcggaaccccgataataatggaaatcaaaacagatgtgacgacaagcgccaacgtttgcagcatcggcgaccaataacccaaataatcaataacaaggaatccgattaacgtaaagagtgcaattcctctcgtactgatccaccaagcgagagctgcaaaaataacagtcaataaaatagacgggatgaaacccaaaccgctcacaatcgcgtttacgaaagcggccaaaccgtttgagattccgtcaaagaaacctccgaacgtcatggtaagccagtcaacaaaccggtcaacgatatctgctaacggaattctaggcaatctgtccatttacttcaccccctgaacagaagaatcctgagcttgttcagcagaatcttcaacatttatataatcgttatttcctgaaagcgcgccgattaatgcgccttttacgacaatgcctttcatgcggtccttatcgtccgtgacggcgatcggaatattcgcatcagacacgacatcgaaaatttccgtcaagtatgtgctttcatgcacagtcgtaaattcagtatttaaaatatcctgaagcgataagtcggattccaccgcttttttcgcatccgccgcgtgaatgacgccgagaagctgtttctgtttatcaacggcgtaaatagaagaaataccgagattcttcatgagctgcagcgctacacgaggccctttgtcaatccgcacggtttcagcgcgcttcatgatgtggcccgctgtcagaactttggataagtcaacgtcctcaacgaatttctcaacgtattcattggacgggctcatcagaatttcttcaggcgtcccgatctgaacgatgttaccgtctttcatcagcacgattctgtcgccgatgcgcaatgcttcatcaagatcatgcgtgatgaagatgatcgtcttgccgacagagtcatgaaggtctaaaagctcatcctgcatgtctttgcggatcagcggatcaagcgcactgaaagcttcatccatcagaagaatgtcaggatcattcgtcaatgcgcgggcaagtccgacacgctgctgcattcctccgctgagctgatctgggaattggtgttcaaagccttcaagaccgacaagtttaagcgaatcaagcgctttttgctcacgctcttttttgtcgacgccttggagttccaacccgtattccgtattttcaagaatcgttctgtgcggaaacagcgcaaatttttgaaagaccatgctgatttttttccggcgcacttcccggagctggtcttttgacatatttgttatcatgtcaccatcaatataaatattcccggcagtcggttcaataagccggtttaacagccgaactaaagttgatttaccgctccccgatagacccatgatgacaaatatctccccatcatatacatcaaagtttgcttgattgacaccaacggttgatccggtcgctttcaggatctcttttttgttttttccgctggacagcatctgaatggctttttttgtctgttttccgaaaaccttagatacattttcgacttttatcttaattggtttctcatccaaattcatattttccctccataataagcaatctttaataccgtaacacgtttgtaataagtcaaacaaacatcataatcccgtttattttgtatcattactttaaaaacatccctgtgtcttattttcctctggtatgcttctaaatactctctaatcctccttattgaggataaattataaaggaaatcgggcttttatcaggcttgagaacgtttccatcgaatgtgctgcaaactgatttcctatcctttttttacaaatacaagaatttttttgcgacattgtcccggaaaaagaagttttcgcctcctgaaaataagggattttaaggaaaaatataggtctgccaacagacagctcactaaaaaaagcaccccaaaagggtgctcattgcgcaagctctgtctgtttcgtttcttttccgagaataataatggtgatgacggcaatcaggatggccgcacaaaagacagcgaaaatagctgtaaacgaaacgttccgtgctgcaagcgatccgacgagaagcggaccgaaaatgccgccgattctgccgacggccgcggttgttccggaaccggtcgcgcggatcgccgcagggtactgctccggtgtataggcgtaaagcacgccccatgcgccgagattgaaaaaggacagcagcatgccggccgtgagcagcatggccaatgaatccgcggcaccgaagaaataagcgctgcccgccgttccgagcaaatagatgactaagatggtcttccgccccgctttttcgatcagccacgccgctgagaaatatccgggaagctgggcaagcgtcatcagaaggacgtattcgaagctctcaatcatgctgtagcctttcatcagcatcacgctcggcagccataaaaacatgccgtaataagaaaagacgacgcagaaccaaacgacagacagcagcaccgtcggccggatatacggtttcgtccagacacttcccgcctgcccgcgtatgctttttttctgcgtcaatgcctgatgcgccggtgattccggaaggcttttccgcaagtacagcgcataaaacgcggccagcgccgttaagagcagtgcggcctgccagccgaatgacggtatgacaaagtaggaaatcaccgccgcaagaagccagcccgctgcccaaaagctctcaagcagcacgatgatccgtccccgcttttcgggagcggacgcttctgacacgagcgtcgaggcgacaggcagttccccgccaagccccattccgatcagaaaacgcaatatgagaaaaaccgtcaatcccgttgcaaaagcggatatgccgcttccgacagaaaagaataacagcgtgatcataaacacttttttccggccgatcctgtcggccagcattccgaataaaaaggcgcccgctgccataccgatggaattgacgcttccgatccatttcatttgatcgggtgttaaattccaatcagtgtgaagcgcggcgataataaacgataaaattccgacatccatcgcatcaaacagccagcccattccggcaatcgccagaagttttcgcggagtgacggcaggttgtttgttcataagcagcacctcaaatcgaaaatgattaccgtataagtttacacctgtctttacacattgtcattatcttttttcgcaaaaaaacccgcttgccgtaagcaagcggggtgcagattaattctttaagactgcgtttttaatattatcctgaagctgttgaatccgtttcgctccgtcttctctgatacgtctgttctcttcctcgatctgtttcgtttcctgcataccgctgacaatcgtattccaagacgtttcaatcgtctcaatgtcaatgctcggacggcctgccatacgggcaatctccacgctttggtttgaaatattttcagcgttgcgcttcagcatttcattcgtgcggcggtccagctcgctcattgaatcagccacaagcttttgccgtttgactgtgacagcctgaatgatgccgtttttgaaaatcggaatcgtaatgacgaaagcggaattgatttttccgatgagcttcgtatttccgcgctgaaggaggcggatctgcggcgctgtctgcagcgccaccatccgcgccatatctaaatcatagacacgttcctcaagcgcctgaagcccgtcacgcagcgtatcaagctgcatttgcgcaagctggtttccgccggccgctttttcttcataagaaggaatgagcgcctgcatttcctcaagcttcatctgcccggcgacaacatatttttcaagctccatgtagtagttaatgttgttttcatacatctcttcaagcgtatggttcgtctttgccatttcatctttgtattttgaaatttcgacgtggattttttcaatttctccgcccagggtgcggtacttttgaaaaatcttttcaatcatgctgttgccgcgtttgaacattttagcgagaaatccttttggttcatcgaaatcatttttgtcgaaacggtccatgatttttccgagctgcgtcagcattgtgcctgaatccgtgacacttgttgttttcatcatatttaagatgcggtcggagaacttcgagatttcaactgccggttcttttccgtactcaagcagctccatttggtttttcacgtcaatctgctgcgaaatgcgctgcacctcagggtcttggcgcagctgcgccctgatgtcatctgctttttgttcagaaatctcttcatttttatcaagaacaagcggattttgattttctgtcatatttatttactctccctgcttttgcgtaatggttctaaacagctttcttacgagtgacggctccttatattcctgccgaaacaccatgtcctccagccaatggacatcaaattggctttcttcaatataatgctcaatgtcctgatggcccggcggattatacaagatgatatcgacgccgaatttatttaaaaacaaaagagcggcggcatcagaacgtgtgagttcgccattttgttccgtatgatataaaacgagtttcggaacggtttgggcgtaatcaaacgtctgaatcaattgcagcagcgaagcgggcagattcgtcgcctggcggaacaaatagattgcggcatcccttgactgctccccgggcaaagccttcagccctgggtttctgcacatgtcagaaatcacattggcgatggcgctctgcacacctgaaggcagatgcttgtactgccagatgttgcttcttttcagcctgtccgcgtcaatctctcctttttcatttaaaacctgactgtagtgatactggtagttggctttcagctcttccgtaaacggaaaactgcggatcatgtgtgtctcctgatagtccgcggcggtatggagtctgttccaatattctttcgtatctttggaaacccccatcactttcgcaaaaaggttcggaacggccacccgctccctgtccgctttaaattgcggccggataaacgcccgctccttcgcaatgagaaataactcatcatacgtcgtttttaaggtcacggactgcggggtgtgctccctgaactgccaaggcttatacatcatggattcctcatggttcagcacatgctcaatttctttcgttgaccggtaggccgtcgtggacgttctgtccggcttttctttcggaaaaggctcaagaccgcctgttgcggggagctttatcacaaagctgagctcctcatccggatcaatcaagctgaacggatcttccgcagccggatgaaacaataggacatcacagccgatcagcatgagataatagagaaaatagagctggcttttggtcgcgtctccataccacaccaccttcggcatctcacactctatatcggcttgttcgagccatggattcaggtggttcagcgaaaactttgacacatccaagagcacacgccggaaatcgggatgattcagcccgttttcatgccggtccgcaaaggtttccaaaagcgtcataaacgcggtcctcagccggcggtgcataagcggatcagcgtgtttggcaagcagcctgcccccatcgagaaacgcgacaaacctggaaaccgaaagccctttctctttttgattgaccgaatgaatgtgctgcagcgcctgaaacgtttccggcgcgatggtcttatccagcgtctcgctcaacacatggatgttttcatgagaagacagctcgaaaagcttactgtaatactccgtctcatcataaggagtgcccaaaatccggccggcaagccgggtaaacgccagcccgttttcccgctcgtaaccgggacgttccggcagcggccgcatcagaaacgtttcccagtcatcgttttccggctcggcctttcggatcaccaattcttcctgcttcatcattttcctcctttctcttcatgataatcggtacaaaaaaggaaggaaatgaactctccctccttttttgttttattcttctttagatgcagccgtctgctcctgaacctgcttttgtttgttgaaatagtggataataaacgtgaccacaaatgcagcgatgatgattccgaagaacaccacgtgcggcatttcataatcaaaagcgctcgccgccattttcacggcgataatcccgatcagcacgaaagccgtgttttcaagctcagggattttatcaattaacacaaggaatacttttgcgactgtacgcatcatgagaatgccgagcataccgccgatcaagagcacccacactttttccgataccgcaaacgcggctaaaatgctgtcaacagagaaggccagatccattaactcaactgaaacgacagtggcccagaaaattccgaacgtacggaccatccatgaatttttcttcatgccttccgtatcgtcatcaccttctccgatccagaaatgcttaatgacgagccaagccaggtacagcgcgccaagcactttgatccaccagaacttaatgagcagcatcccgattccgataaagataaagcggaaaatatatgccccgaacaatccgtatgttaatgctttcttccgctgtttttcaggcagatgccttaccataaccgcaagcactaacgcattgtcggccgacagcagcccttccagcagaaccaaggaaccgatcagcccccatgatacagggtcagtcagcacctcaccccacattttccaatcaaaaaaggaagcgtaggtcgacataatatgatgtagaaaatccaagttttttcctcctatttagtaaaacggtaatttcctgcttacacctgcaagccgtaattccggcaaagtgatgccagaccgccggaaaacccgctgccgatggcgttaaacttccattcagccccatggcggtaaagctcacaaacgacaaccgccgtttcaatcgagaagtcttcccctaaatcgaaacgaagcagttcattctggctgttttcatcgacgacgcgcacgaacgcgttcgaaacttgtccgaaattttggccgcgcgcttccgcatcatgaatcgtgacggtgatgccgatcttttcaatatttgcgggtatttttgagaaatcgacgataatttgttcatcgtctccctctccctcgcccgtccggttgtctcccgtatggatgacgccgccgctcgggtgttccaggttattgtagaaaacaaaatcaagatcattaacacagttgtcatgggcatcgacaagaaaagccgacgcgtcaaggtcaaagtcatgccctccggagtacttgttcgtatcccagcctaagccgatcaccgcttttgtaagaccggggttcgtttttgtcagatcaacacgctgtcctttcgccaattgaatagccatgtgccgtctctcccttctgtgcttgatatggttttagccgatttgcaggccgtaatctgtcgcaatacgggccagtccgccttgatagcctgagccgatcgcggaaaatttccattcgccgttatgtctgtaaagctcccctgcgataatggctgtttcaattgagaaatcttcagccagatcgtagcggatcagctcttcatttgtctcttcattgacaatgcgaacgaacgcgttggaaacttgtccgaagttttggccgcgcgcttccgcttcatgaatcgtgatgacgaatgaaattttgtcaatagcggcaggcaccgcgctcaggttgacccttacactttcgtcatcgccctcgccctggcctgtaaggttgtcgcctgaatgtgcgacagagccgtttccgccttcaagctgattatagaaaataaaatcatcgggcgacgcgcatcttcctgcttcatttaatagaaagacgctggaatctaaatcaaaatcatgtccgccatcgtatttgtttgtatcccagccaaggccgacaacgactttagaaagacccggatttgttttagtcaaatctactttttgtccttttgccaatgaaattgccatgtgtgcactctcctttttatcgtttaggcgtatcggttaacgatatcgccgatttttgtatcgtttgtgccttctcctactgcggcgaatttccactcgccgtcctcgcggtagatttcagccgcgatcaggctcgttctgcctgaatagttatctcttaaattgtaagtcaccagttcttcgcgattagcctgatcaacgacgcggatgaacgcgttttgaatcatgccgaagtcctgttttcgtctgacgcagtcgtaaatattgacgacaaacacaagtttattaatctgagcgggcactttcgacaaatcgatgagaatttgttcatcatcaccgtcgccttcacccgtcaggttgtcacccgtatgtacgacaccgccgcaccggcttttcagattgccgaaatagatgacgtttttgctgtctgtcattttatcattttcaagcatcagtacggaagcgtcacagtcgatattggcaccgcctccgccgaacagctttccgaaaaagccgccggatgatacagggtcccagccgagtccgaccagcagttttgacaggccggcttttccttttgttaaatcaatccgctgtcctttttgtaaagagatcgccatatgattcactcctattctgtaagggtgccgctaagcacgccgcaagtgcgcatttttactaaattccgggacaagaatcccggtgtttattaagttatacgtcttttattatatcaaagtttcataaaacataagaatttttggcgaaaaacggcgaaaaattacttcctatattctccttcgttccggagagaatagagaaaacaaagaaattgacggggactgaacatttttcctatccttgtatcaatacatgtcaggaaaggggcagacgagtgattgatttaagcatacttgatcaggcgcccgtatccaaaggaaacgggccgcacgagacgctccgccgttcagcggagctcgcccgcctcagcgaaggatggggctataagcggtactggtttgccgagcatcacggcacaagagggctcgcaagcgtttcgccggaaattatgatcgctcataccgccgcagccacaacgtccatccgtgtcggatcaggcggcgtgctgctgccgcagtacagcccctataaagtcgcggaaactttccgtcagcttgaggcgctgcatccgaaccggattgaccttggggtcggacgctcaccgggcggcacgacgaaaatccggctcgccctcacagacggggtaaagaaaagtatgaccgagttcaacaggcagcttcaggatttatcatcctttctgacagattcggttccctcggaccatgcttatgccggaataaaaacagcgcctttgattgaaacagccccgcagctttgggtgctgggcctcggggaaaacagcgccagacgcgccgctcttcaaggtgcgggctatgtcttcggccatttcattaatccggaacgcggggtaaaagcctttcagatctatcgggaccatttccgggcctcctcccatttttccgctccggcctcactctgtgccattttcgtcatatgcgcagctacggatgagaaagcggaagaactcgccttaagccaggatttatggcttcttcgtgtcggaaaaggcgccgacagccgcgtgccgagtgtggaagaagcgaaggcttatccgtattcgccggaggaccgtaaacagattgcagaaaataggaagcggatggtgatcggctctgctgccgcagtgaaacgccgtctgcttgaactttccgaacgttatcagacaaaagagatgatggtgctgtgcaacgtctttgatttcgaagcaaaaaaagagtcatatgagcgtcttgctgatatatttctgtaaaaaaagccgtcaaacggcgcagcagatgagactgctgcaccgcttaacggcggttttttcgttcttttccttttttaaacgcattccaaatcccctgcagcataaagccgagcagaagcagaatgattaacagtaaagtgattgacggccccggaggcgttccgagctggtacgaagacgtcagccccatgaacacactgaaaagagaaataataatggccgccgcaaacacccatttaaaccctttggcgatacggattgcaaaagccgcgggcagtacgaggagcgcggaaacaagcagcacgccgataatcggaataatgaccgaaatcgccagccccgtcacgatgctgaatgacattgacaggagatttgtgttaatgcctgatgtcttcgccgtcgcctcgtcaaaggtaagcagatagagcggtctgtttaatataatgaaataaagcagaatcagcagggtaatgcctccgataatatagacctgctgctggctgaccgtgacaagcgatccaaataaatattgatcgatgctcatcgacgcgccgccttttgacaggctgatcagaaacatcgcaaacgacagcccggccgccattaagattgcgatggatacctctgaatatgtacggtatgcccgccgcatatattcgatgccgatcgctccgatcgtgacgacaacgatgctcgccgccgtaatattggtactgagaaaaaaaccgatggccacgcccgacaatgaaatatgagacagcgtatccgccatcagcgcctgtcttctcagcacgagatatacgcctaatatcggcgccataattccgatcatgcttcccgctagaaaagctcgtcgcatgaattccaagtcaaacatttccatccgcctttttcccccctctcaagccgtatgactttatccaaatactgctgtacttcattttgttcgtgtgtcaccatgacgacggtgcggttgtgatttttcacctgatgatgcataaattcgtagaaaccctgtctgctttcatagtcaaccgcggttgtcggttcatcaagcatcagcagatccggattgcttgcaagcattctcgcaatgcagattttctgcttctgtccgccggataaatcgccgattttccggtggcggaaatcccacatttccaccatcttcagcgcgttttccacctcgtggtgatccgtttcgttcaatcgtttaaaccattttcctttcgtataacggcctgattgcacaagctccagaactgtgcttgggaatcctgcgttaaatgaagaaatctgctgcggaacatagccgattgtcaggcgttttccggcagcgttttttttactgatctcggccgttccttcccaaggtctgagcatgccgagcatgactttcatcagcgtcgattttgacgcgccgttcggtcctgtaatgccgacgaattcgccgcttttgatttccagcgacacaccgtcaagcacgggtgtatgcgaataaccaaaaacgatatcctgtaatgtaacgagattcatgctgaccttcctttcccgcatagaaatagtgtgcaccccgcggcgcacactatgttatttaaccaatagcgaatctttcagtgcatcaaggtttttctccataatgtcgatataaccgatgcctttatcccgttctttttggcttaaaccttccagtgtattgagcacttccgttttcgcgccgatttcaccggcaagtgtatctgcaactttaggcgatgcaacttcttcaaaatagatgatcttcacatcatgctttttggcaaacgttttgagatccgccagtttggccgcactcggctcttcttcaggagaaaggcctgcaatcgcgacttgttttaagccgtattctttggcgagatagctgaatgccgcgtgctgtgtgatcaattcttttttcgacgctttatttaatgttgtacggtatagtttatcaagatcctgcagttttgcaatatattctttactatttttctcatagtatgctttattcttcgggtcctgttttacgatctgcgccgtaatggttttgacctctttttgcgcaagaaccgggctgagccacacgtgagggtccatgctgtggctgtggtcatgaccgccgtgtccatgttcctcttcctcttcatccgaaccttcgagcaagtcaattcctttcgacgcctttacaaacttcgcatgatcagagctcatgcttttttccgctgaaggaacccatgtctccatatattcgctgttgtatacgaaaagatcggcgttttgaatgccggcgatatccttcggcgtcggctcccaatcatggggttcgaccgaagacgggatgagaatgtctacatcgcctttgtctttgacaatttgtttcgtgaattcgtacataggataaaaggtcgtcacgacgtgcagtttgccgcttttcgaagaacctgacgaaccttttgaagatgaattgccgcagcccgccgcgattaaaaagcatgccgcaatgacaatgattccgctccattttttaaacaagccgtttccccctgttctgtaaatcagaatgatgacgatttccaaagcgtactttctcgttcatttgttacctataccataataaaacgaagtaattacgttttgcaagtaatttttttctaaattgataaccgatttacctaaaaagcccccgccatgtatggacggggcgtcgtatcacatatcaggcatgcagataaactcttgtttcgtaagggcggaacgtgatgcgggattccgctccgccgttattttcatagttgctgagaagcagctcggccctttcagattcggagccgtccggccaataaaaggcggcttcttctttcgatacgttgctgatggatatgattttttgtccgtttgcctgtctttcatacacaaacagctgcgggtcatcgggaaacagcagcgtgtagctgccttttatgatatcagcatactgttttcgcaggcggatcagttttttgtaaaagttcaatatagaattgggatcatcctgagcctcggccgcattgacggttttgtaattgggattgaccttcagccacggttcgccctccgtaaatccggcattcttgctgccgtcccactgcatcggtgtacgggcatgatcgcggcttttcgccataatggacgccatgacttcttccctgttgcggcccatttcaaatacccttttgtgatacatattgacggtctgaatatcttgatagtcctctattctgtcaaacggggcgtttgtcatgccgagttcttctccctgataaatgtacggcgtgcctttcatgaaataaagcagggcggcaagcattttggcggatgcctttcggtatttgccttcgtctccgaagcgggatacgatccggggctggtcatgattgcaccaatacagcgtattccagccttgatgttccagtttttcctgccagtctgtgagcactttcttcaaatcggacagctcaagcggttttacatcccaatgctcttggcccggcttttgatcaagctccatatgctgaaaatgaaaaatcatattcagttcatgctcatcggttcccgtgtaaaccagcccctcctcaggcgtcactgatccggcctcgccgaccgacatcacgtcatattttggaaaatacctctttcgtcatttcttttaagtaatcatgtatccgtgctccgtttggccggaaaggcttcggatctgcccggcgggcgatgtaatcttcatatggcggcaagtattctttttttgacagaagatgaagctggtctattcgcaatccgtccacgcctttatcgagccaaaatctcatcatctcgtatactgattgccgaacctcgggattttcccaattcagatcggcttgtttaacggcgttcatatgcaggtaatattcgcccgtatgttcttcgtactgccagacggattgtccgtaatccgacacccaatcggtcggcgggccctccgcggtgcccggccgccaaatataataatcgcggtatttgctgtccggattcatttccgcctctttgaaccaaggatgctccgtggaggtatgatttaaaacgaagtccatcacaagctttaatccgcggctgcggcattctgtaagcagatcgtgaaagtcctccatcgttccgtatgattccataatcgcttgatgatccgtcacatcgtagccgttatcgacgtttggcgacgggtaaatcgggcagatccatatcacatcggcgccaagctcttttatataatcgagacgcgcgataatcccccgcaggtcgcctatgccgtcgctgttcgtatcttggaagcttcgcggatagatttgatagacaacggcgtctttccaccagtcattcgccatcttgcggccctcctgttttttagagaaccatttcctgtatgccccttctctaaacaaaaaagagaaggtttcccctcctcttttatctttccagctgggacggataaagcgtcatgcctccgtctacgaaaagtgtcgttccggttacgtaactcgcttcttccgacaccatccatgcggcggccgcggcgacttcttccggttttccgaaggcgttcatcggaatttttttcagctgggcctgtttatgtgtttcatcttccagatccttattggactccgtggcgatcgtgccgggagcgatggcattcacccggatgcctttgtctgcgtaattgagcgccatcgtttccgtcatcattttgatcccgcctttggatgccgagtactgcacgttttcaggacgcggtatttgctgatgaacgctcgatatgtttaagaccgttccttttttgccgtgctcgagcatatgtttcagtgccgctttcgcccccaaaaaggtgccggtcacgttgacgtcgatgaccctttgccaatcctccaggctcatttcatggggcatcgcttccgctccgttaaagccggaattgttgaccatcacgtccacgcccccgaaatgctcctgcgcggcattaaacagcgcctgaatcccttcttctgaggatacatcggcttttacggtgacggctctgcctcccgctttctcaatgatatccgccgcttcttccgctccggcggaatcaccgaggtagttcacaaccacattcatccgctccttgccgaagcgttcggcaatggcttttccgattcctttcgaagaacctgttacaatcgctgttttcccctgtaaatcctgatacattgtctcatttcctccctgatgttaatacagagcatgtacccggttttaatcggctgaaaacaaaaggaatcataaaaagaacgatgaaaccgaagctccctcgttcttttttttattatgcgtagttgttcatttgcagccttttttgcacgccgacaagcctgctgaaaaaataagatgccgctttgtagttctcccgtttatgaaagaaatgagccgcgtcctgaagcagttcctctgtgtcagccaacagctcctttgattccaggatgtcaaaatactctttgagcgaatcctgtccgccttcccctgataaagctctttaatcagacggaatttcgtcatatagatctcatcttcccactccgccgcgcttctcatgccccgcgcgcagctggcggcggcttcactgtatttttccgttttaaagtagatatgcgtgagtgaaaaaacagcctggatgacctgccggaagctgtgtgcttcaaatccggcagccgcccgttcaaaatcctccgccgccttgcaaaagtcacccagactgtacatacagtgcccgatattataataggccgcagcaatcatatattgatcatcaagccgctccgcgtgctccaaggcgcattcgaggtattccagcgcttttttatgctgctgggcgtccatcagatttccggcaatgataaatttgcactgcacccttctcattccgtataattcatatttcttgtaaatatcaagcgcctgccccgcgtaattcatcgaaaagaaagtctgcttgatatgatagtacacctcagaaattttatacagaaactcggctttctctatgtcatcttccacatattcaagcttttcctcagcccgcttataatgagaaatcgctgagatgaagtttttctgcttaaattcatacattcctctgaaatagtaaaaataatattccagtaagccggtcagcttttgctggttcatctcaatctcagtgagcatttcagagaacggaggctggcagtcgccgtctttcatgggttttaatttatccagcatgatgcggtgcctaaattccatcaatgaaaaatacaacaataaatcctgattttcttccatatcttcgagttcatattgaatctcccgcttcagcgcttcagctttatcggcttcaaacgcgcggatcagcttataccattcattcatctttacggccacttcttcagatggaatcttggatttcatagatttgcctccttcctccggctactaattatgttatattttatcatagcaaatttatggcagtgagcaaacaaagattttaatcaattaaagaaagagagaattcaccatgaaactaccagtcagaatttcgctgcttctgatcctcttcttttccgcagacctatgtttttcctatgtgcagaaagaattgaggccgcagacggcattacaagatagagccattccaagcgctcttcatccgctcgtgaaacagaatgcggagctattgcggacggccgctctgaaaaaaggcatcaccgtcgttatcacagagggtttcagatcaattgaggaacaaaacgaattgtaccgtcaaggacgttcaaaaaaaggaaatatcgtcacctacgcaaaaggcggggaatcttaccacaattacggccttgcgatcgacttcgccctgcaaaaaaaggatggaagcctgatttgggatatgacgtacgacggaaaccgaaacggcacgcccgattggcttgaggtcgtatcgattgccaaaacgctcggttttgattggggaggcgattggagaggctttaaagattatcctcatttacaaatgatccctggctaataaaaccttttcttttttcgcttctgcgcatcaatgtacggaggatagacaggcctgtacacaagcttatatccttcattgccggacggcgtaaaatcgcgctgccactccagccgcagatggaaatcggataaaaaagcggcctttgcttcttcgggagtaacggccggcaccggattgatcttctccagctgctccgggtcaatgtcaggcgccatataagcttccacaagccccgttacgggactgacaagtattctcgcagcgccgaaccgcagcggaatatcctgatgccatacggaaaaatggaagcggaacctgccccttccgtccgttttcagcgggttcattttaaaaaactcgtccgctctcggataaagcttgtataaaaattgaagcgcgacggcctcacactcttccgcagaataaaaggccgggccctgatgctcaataaaagatttaaaggctgtcattttccctgtctttttgtccgttttcatcttcattgtatttttgttgctggtttcaaaatagctttcgatactcaaatctttccgttccggaaccgaccctttccgccatgtcgttccgatctcatccccgagatcgcgccggcgcgtctgaaccatatccgaggtaaaccccatcaattcatccaggctgatttcccgtttatgttcaaacgcaggaagcggttttgccggctcattcctgtcttcgcaaagctgctgatccggcacgatatcatcttcaccggccggatagctgtaagccggcagaatcggttcatagacgagacgcggtatgttctcaaaattgaccacatcatagacgagactgaatgtcagcacactcatataatgcgagacgactttttcccgatcgacgaatgtttccgggacgggcgcttcacccttatccccgtaatagataaactgcacgacgaagccgctcctggttacatcaacgaaaaaacctgaatcgggaagcggccggccgagcactttttttgtatagataaatcggatgcacccattgcgttcttccctcgcctgaaagatgaaattcataaaagtaagcgggcggtgtctcgccgcaaaccgaagagccgtcagctttaattcggcgtctgacagctgcatgtctgaacccggacagtcgttgcgtgaataggtaagcaaagatccgtcgtcgcccagctcaatcgttaccgttttatccggatggttacgatctttccatatataataggctctcgttttttgtttttcatcataatcttctatttcaagctcatagtgcggcggtatgttcccgatctccagcgctttttttctcagatgttctttcagcaatggggtcatcctttcagaagagtgtataaaaaagaactgtttttaattatataaaaacgtccttatccttttaaagggaagaaagtgccttttatgtgtctatttttagcaaagagggaaaagagccgtattcagagcggctgtttttcatacaatagtcacaattcccgcaaaagacccgggacgaacgcccatgaccttcagcctattaaactcgtgatcacttctcccgtatgggcctcaataaaccgcgggaaaaccggcttgtatacgagcctgtacacttttccgcagctgccgtcatcgtaacaacgatcccaagcgagctcggctttgatggcccggcggatcgcgtccttcgcctcttccattgtcaatgaaggaacgggatcgatttcctccagctctttcggatcaatttccggcggcatataaaacgtgacaagacccgtctttttgctgacgcagattctcccctctccgaatcgcaaatcaacgccgcccgaacaagccttatatgtaagtcccacgttttctccttcatcatccggctcatcatattgaacccggaaatactgatccgcttccggaaacatggcgaataaaaagcggatggccatgtgatggcattcttcctcggaaaactccggttcgccttcactatgtataaatgacatcactccggcgagccggcccgattctttatcatgcattgttttcaatacatgttcattccgttctttaaacagactttctaagcttttatctttccggacggattttgttttttcaggacgccatgcaatgccgatgcggccgtctccaagatcagtttccctctctttataaaaaccgtcgtgcagcccgatcatgtcattgatgctcatcttttccgcttcaggtgcagggcgtgaaatcgggacatacggcagcatgtcgtcttccagcccttcatattcgtctatttctgcattctcttccttcaggtcagccgatatcggccgcgtcggagacacgatttcatagacgagatgaggcttgtcatccccctgcacatagacggactgatgcagtacggtgaacaacagctccgcttcaatatgtttgacaaagtgagccaatgcttcccgcttgtccgcaattgttccgggtcttaagagattatcagccttcccatggtaagaaaagccggttacttcccctgtcaaagacaggtcggcgtaaaacccggtcagcggaagcggcagaccgtcagccatctgaacataggaatatctcacatcaccatcatttgcggagccgctgttttccaattcgaactcagccaatgcccccggacgatgggtttctacaaacgcccgcatccgttcttctatgtccgattccgaaagagccggcagatcagtccggaaagccggacgggataaggatttcagttttccgtcccggtccaattcgaccatgatgccggcttccggatcattcttatcttcccaccaaaacaaaacctcatcttcttggtattcttccacattactttcgtagcgggcaggtacgttaccgatccggagagccagctgtttcaattcttcttttttcatcataacacttccttttcttccaaaaagattgatgattaccaagactcttttatacaaaactagtataattaacctgtctgtcttcatgactattgaattaatcattataacaacagggggtaaaccagatgtccatcaaaaaaatgagcgccgtgtttttcatactgcttctcacggcatttaccgccgcatgcagcagcgaaacgagcggcggccaggaaagcagcacggcgaaagtgaaaataaaagagacggcatgggccgcttcagacgatactgaacatccggccgcgctgaaagtaacggtcaccgtcaaaaatacgggcaaagacccgcttaccgtcaaaagcagcgacttctcgctttatcaggatgacgcgaaaacagcggcggccgataaggatgaccagatgcagagcggcacgcttcatgcgggcaagacagtgacgggcaatctgtacttcacggctgacgaaggcaaatcatatgaattggtatatcagccgcaggcaaaagacgcgaagcctttatcttataaactgaaagtcaaaggcacagcctcaaacgcaaaacctgacccggcggacgcattatccgcatacattgatgtgatgctgtacggcaagcacaataaagatttcacccgcctgaccggtgtaaatgaaaaaatgacggccgccgcatatcaggaatcggcgaaagccagctttatcgcttctgcaggcatttcacaagaacaggcggattcaaaagccatttccgctattattgacgccatgtcatcagcgcttcgggataacacagagctcaaggtgcataccaaatccatgtcaggcaaaaaagccgtccttgaagcaaaagtgacgccgcttgatatgtctccgctcgcgggccagctgcaagaccgcgtgcaagactatgccggaaagcaccccgatgctgatgaaaacgaaattgtcagccacctgctttctgtctatccggaagagtttatgcgcctgaaaccggcttcttcttccgtaacaagagaaatcgagatgaagaaaaacgcccgcggccagtggtatctggatacagacgccgatctggaaggattgacagaagcgtttttgaaaacgtcctgacagcaagaaaggaaatagcgcaggctatttcctttttttattttcacttgaagatgtcactgatatattgaacctcatcctcggtcaattgcacatcaagcgcgcccagattgtgtttcagctggccggggcgtttggctccgggaatgatcgcatccaccgccggctgcgacagaagccacgcgagtgcgatatgcgctgtctgcgcccctttttcttccgcaacggcccgaagcttatccactcgctccaggttttggtgaaaagcttctccctgaaacggcggcctgttttttcggctgtcctcaaagactgtgtcttttgtaaactttcccgtcagcaagccggaagcaagcggaaaataaggaataaaagaaataccgttcttttcacaataaggcagcagatcatgctccgcctcacgctgaatcagtgaatattctgattgaaaaacctctaaataaccgtcggcgttaaactcctgcaattgcccgaagctgagattggacgcgccgattgctctgattttcccttcgtccttcagttcttttagcgtgcccgccacttcggagagcggtgttttgccgtcagggaagtggacgtaatacaaatcaatcacgtctgttttcagccgcttcaggctgttttccgcctcactacggagaaattcacggctgttgtccagctcgatttgtccgttgacctctttgtgcgcgccttttgacgcaatcacgaggctgtcccgcacgccgcgctctgcgacaacttcaccgattaactcttcggaacgccccaaaccgtatataaacgccgtatcaataaaattgacgccgccgtccaacgctgtgcggatgagttcttttcccgtttcatcattaagattcggaaacagattatgtcctccgaccgcattagcgccaaagccgatacgctttacccgtaaatccgtcctgcccagcgtacgtgtctcatccatggctcaggctcccttccttttatcgctctgtttagtattagataactggtaagaattatcctgccccgagagcatttctgcagaaaaaaccttgaaaagcatgtgcccttcaaggttttttggctgtgtattaagatgtcagagctgcggcgaagcgttcggcttcatctgtgagagcaccttcgatttccttatagcggctggaaatcgttgaggcgctgacgccgtacttcttcgccagcttggcttgagaaacggacgcgccgttcagagaaatactgtttacgtaatattcaaccgccgccgcgaaagcttccggctttctgatcgtcggtgtttttttgacacagaacgttttccacaggtcaataacggccggaaccagctcagccgggtattcatccccgctcaggcctttttcaatggcgtccgccgtttccttctccatgtcgttcgcccactccgtctgtttttcttcagcagcctgctcaggctcttccgccgttcctaaaagagcggccagcacagtgtcgaagtcctcctgcataaagcgctcaggcgattttccttccgcaagggccggggcagccgcctttttcactttgctgattagagcttcggtccgcttcacagggaagatcgtaaactgcataaagaactccgctttttccgcttcgtggatcggatagccgagaatcaggcttcccgccggcggaagatcctgctggctgacgtccatttccactttgaattgtttcttggtcatcacatcttcaaagtgaatcattccttctttcacatcttcaagcaccataaccgctggtgtcatgcttttccatgattcaacgatttcccgtgttttcggacggttgatgccgccggcttttttctgaagatattcttcaaaaatcgtcttgccgcctgccagcggacggaagaaaattccccagataccgaggttgaagactccgatgtctttagtctgtctgtccagctccgtaatgaactcatgctggttaataaatgatgatatgccgtctctatgtgctgtaaaggcgtactccattaagctttcctgaatctgtttcgcttcttttgccgcgatgtctgccggaatggcagcttctttgcttccgcagcattttttatatttcttcccgctgccgcatgggcaaggggcatttcttttcacttttcccacaataaaccctccgaattctgatataactttattattttaacaaaaataacttcagagggcttggtttacggcgaaaaaagaatatggaagaaaaaaaggccccgggatattctcattctccggggctttgaaactgttaatttgtattttgtccgccgccgttcagaccttctttaatcagcccgtttacttggctgttcatcaaaagtccgatgtgtccgacaccgtgaatctgcacgtttttcccgccgatcagtcgtgacagcgggttcagaacgatcaagtccgctgagctgtaaatcgatgtatataaaatcttttggttcggatcagtccccggaagcgcccggttggtcacaaggccgttcgctccgccgagtgtgacgacgttggcgattttgtctccgccgtcaagatttttaatgtaatagagcgtgttggcgccgcccatgctgtgcgcgacgatatcgacttttttcgcacctgtttcgctgagcacttttttcacgtaattggacagtctcggcgcattgtgtctgttgtttccggttttgtctaagaaatcaatagcgtacatctcttttcttgaccagccttgggatgccaagtatgttttgattcccgcaaagttaaaagacgccccgccgattccgtgaaccatgactacagggttatgccctgaggaggctttcgatacggtcggctggaaggcaaatacggaaatgacggacagcatacaaactgtaaggatgactaggattttgctttttatatgtttcatgaactttcctcctgctatgtaatatttttgcagttttcattctattagagaagaaaaggaaaaaatagtgtattttttactgttttcaacaattaaaaaagagcggaaaaatgagaaagacgcccctttcccgaaagcacgcttatgctttaatacggcataccgacaaaggagagaacacccggttctctactcctagtactcattgaaataggtttgaatccgcttaggatcttgcgtttttgtcagcgcgagcatgagaagaatccgcgctttttgagggttgagagagtttgaagctgtcaaatggtctttttcatactctcgattaggtgttaccgccccgtttcccgtccttgtggagcggacgaccgccagcccgcttttgaccgactttacagcgccttttagcgccgcatcagacattgagccgtttcccgggcctgcaaaaataatgccttgcgcccctgattttacggcggcttcaaagagatagcttccgtcattttgatagccgtatataatatcgacctgcggcagtttatcaagtttatctatcttgaaatctgtatccttcgtatgctttcgggtgatgatgttattaaaatagacgtcatcagcaattgttccgatataacccatttcttccgatttgaaagtgtcggtcgcggttgtattggtttttgtcacataacgcgccgaagcgattctgtcatttaatacgacaagcgtccccttgcctttcgcctcaggcgcagccgctgtttttaccgcgttatataagttggacggcccgtccgctccgatcgccgtggacggccgcattgacccggcgacaacaacgggtttgtcactcttgaccgtcagattgagaaagtaggcggtttcctcaagtgtgtctgttccatgtgtaatgacaatgccgtctgtatcatcagacttgagcagcttgtttacccgttttgcaagtttcagcagtgtctcgttattcatattctggctgccgatattcacaacctgttctccgctcacatgcgcggcctcttttatctccggaacggcctgaatcagggcatcaactccgattgcccccgccctgtactccgtagcggacgtctttgaaggagcagcgcctgcaattgtgccgccggtggcaagaattttaatattcggaagtccgtcttttttcgcagaggctgcggctgccatctggggcggtgtttctttcgtttgaggagattgggagcagccggccgcgatgaagagcagagccgtgataaatgtaatgaagggcatgaattgttttttcattcttttctctccttttctttatttatgatgattttcctctcaccggtcaacgcgcttgtcaggcattcttccgaagaaaataaccgttaaaaaaccttgacaccgtcatgcgaaatcaagataatagaccagtcactatattttaaatttgtcacaaatcagtaaggtgggaacattatgagctatggagattctcgggaaaaaatcctcgccgcggcaaccaggctgtttcagcttcaggggtattacggcacgggactgaatcagattattaaagaaagcggggcgccgaaaggttctctttactatcattttccggacggcaaagagcagctcgccattgaggctgtcaatgaaatgagccattatatccgtatgaaaataaaagaaagccttgatgctcatcttgatccggcggaaagcattcaagcgtttttacaggacttatcaagccaattcacatgtccggagaattttgaagggtttcctgtcggtttactggctgccgagactgctttaaagagcgaaaagctccggcaggcctgtcaaaacgcttatcaggaatgggagaatctgttcgcgggcaaattaagatcagccggtttttctgatgagaaagcggcggaaatcagcactgttttaaatgccatgatagaaggcggcatcattgtgtccttagccaaaaaagacaaaatgccgatcctccatatttctaaacaaatccccaacctgctgaagacataaaatacgagagacatgtacgtatagaaagagaggagaatgattttggaaaacgctcagccttccaaacaatataaagtcatgccgatcatgatttctttgctgacggcagggtttatcggcatgttcagtgaaacggcgctgaatatcgccttgactgatctgatgaaggagctacatatcactcctgcgaccgtccagtggctgacgacgggctatctgctcgttctcggtattcttgtgccggtatcgggtctgcttttgcaatggtttacgacgagacagctgttcatcgtttcactcgctttttccattatcggcacgctgattgcagcgcttgcgccgagctttccgtttcttttggcggcaagaatcgtgcaggctttaggaaccgggctgctgctgccgctgatgtttaatacaatcctcgtcatcttcccgccgcataagcgcggagcggcgatggggacgatcgggcttgtcattatgttcgctcctgcgatcggtccgacattttcagggcttgtgctagagcatttgaactggcattggattttctggatttccctgccgtttcttgtgttggctcttttattcggcatcgcctacatgcagaacgtgtctgacattacaaaaccgaaaattgacgtgctttccattattctgtctacgatcgggttcggcggcatcgtattcggattcagcaatgcaggcgaaggatcagacggctggtcaagcccgacggttatcggttcgctcactgtcggcgcgatcgcgctcatcttattttccatcaggcagctgacaatgaagcagccgatgatgaatctgcgcgctttccgctatccgatgtttgttctcggtgtcgtgattgtgtttatctgtatgatggttatcttatcgacaatgctcctattgcctatgtatttacaaagcggactgatgctgacggcgtttacgtccgggctcatcctgctgccgggcggtattttaaacggctttatgtctccggtgacggggcgtctgtttgataaatacgggccgaagtggcttgtcattcccgggtttgtcatcacggcaactgtgctttcgtttttctcaaacattaacggcgcttctacggcgcttctgattgtcgcgcttcatacatgcctgatgatcggcatttccatgatcatgatgccggcgcaaacgaacggcttaaatcagctgccgccggaattttacccggacggaacagccattatgaatacgctccagcagatggccggcgcaatcggcactgcggtggcggtcagcatcatggctgccggccagaagaattatatgagcaccgcgaaaaacccgaatgatccttccgcatactctcacgcgctgattgcgggcgtccagcacgcctttatctttgcgatgattgtcgccgttatcggcttgatcagcgctttctttatgaaacgggtcaaagtgaatcattcataagaaaacagcagactccccgtgagtctgctgtttttttatataccgcgcgcttcagccagttcatcaatcgcatagatcagatcgtcagctgtgttatagaaatgaggcgccagccggatgatttgtccgctggatgcgcatacgatgtttttccgcctcaacagcgcagccgtttccgccgctttttcatcccgtatggaaatcatgccgggtctgtcatcggcagacggcggccctgtgagattcagtcctttttcagaagcgtattcatacgcaaatgcgctgagtttttttacttcttggtgaatgcggtctgtgccggcatcgtttaatagagataaagccgcctgtgccgcatatatgctgataaatgccggggttccggtctcaaagcgtttggctccgtccgcataagaaaaacgggttaaatccggcatcgacgcccgctgctgcccgaaccatccggtgactttcggcttcagccgttcggcaagttcctttctgacataaagaaacgccgttcccggtatgccgagcatatactttctcgcacccgcggccagcatatcaactccccattcttttacatcaatcgggatgtgccccgccgattgataagcatcgacaaaaagaagcgatcccttctttgcggatatctcggcaatgcgctttatatcctggacaaaacccgacgtatatgacacatggggcacacaggtgaaaagcgtctgctccgatatgtacgtctcataccgctctaacgggatcattccatcttcagacggcacgactgaaagctccatctcagtctgtgccttcaaaatgtgggcgatcgccggaaaatccaattccgtatacaccgcctgtttctttcggcaatccggtaaagcagaaacgacggcagagacagcagccgttactgaaggtaaaacggcgatttcttcaggatgggcgccgatcaattttgcaaattcacaccttgcctgctccgtacgtccaatggcttcttcccagtttccgccatgctgaaacaggctttcctgatagtcattgaccgcttttgaaaccggcagggcaagagcgctttgagagcagctggcgagcatcgtatgtgtgcggagcaccggaaataaagatcggtattgcaccagaggcgaattcaagacatggttcccccttcggcaggaatatatgtccattatagagtatggtaaaaagaaaaggagggttttatatggagaaaaaagtattactgacaggctttgaccccttcggcggggaaacggtcaatccttcatgggaagcggtcaaacggctggacggttcccatgaaggccctgcctctatcgtatccgaacaagtgccgaccgttttttataagtctcttgccgtgctgcgcgaagcggtcaaaaagcatcagcctgacattatcatttgtgtcggacaggcaggcggcagaatgcagatcacgccggaacgggtcgcgatcaatctgaatgaggcgcgcataccggataacgaaggaaaccagcctgtcggggaaaacatttctcaaagcggtcccgcggcctattggaccggccttccgatcaaacggatcgttgaggaaatcaaaaaggaaggcattcccgcggctgtatcctacacggcggggacgtttgtatgcaatcatctcttttacgggctgatggatgaaatcgcctgccatcatccgcacatccgcggcgggtttatacacatcccgtacattccggagcaaaccttgcagaagtctgcgccgagcctcagcctggatctcgtgacaaaagcgctcaaaatcgccgcggtgaccgccgcggcgcatgaggacgatattgagaccggcggaggcgagcttcactaagcggcagacacctcggcccatttcttccggtaaacgatgcgggacagcgtcacactgatttcatagaggacgagcagcggaatcatgacgagaaagtcagacataaaatccggaggcgtaatcagcaccgagacgacgatcagcaaaaaatacgaaagcttccgcgcctttgccagccgggttggattcacgattccgagccgtgtcagaaacatgacggccagaggcatttcaaacaaaaatccgaacggcaatgtaagattcagcataaaggtaaaatacttgtccgccgtaaataccatgtcaaaatggccggcggataattgtgttaaaaatccgagcacaatcggaaacagcacaaaatacccgaaggaaattccgataataaacaaaagcgaaagccccggaatgtaaagcaaagcggcgcggcgttcgaacggggtcaaagccggcgccgtaaaacgccagagctgaaaggccgcaaccggaatcgctgccgtaagggcgcatattcccgcaatcatcatatacacccataaaatctcgctcggccctaaaacggccagcctgccatgcaaatccttgatcagccagtcataaatatcctgcacaaaccagcaggcgccgataaaaaacacgagaaaggcgataacgattttaatgagacgctgccggacttcctctaaatgcccgatcaagtgggtttcttttttatccaatcgtacatcctccttatagagaaagaggcagaagcggattcgtctgcccccatgtcaggattcagcctgccgttttgtctttctcagccgtctgcttgtccggctcttcatttgagaccaatgtttttgcggcgcttttaaattcaagcagcgtgcggccggcggcacggccgatttccggaagttttgaaggtccgaaaatgatgagagcgatgacgaaaatcaggatcaacccgggaatgccgatatttgaaaacatgagtgtgcctccttattgtgagattttggcccgtttctttctcatttgcttttcatgcgcattgttatgggcgaagaaacgatcctcttccacctcgtttgactgctttaaaccgcctgcaaccgccgcttgagagaccttccgaatccccgtctggtctttctgataaatgaatgaagcccgcgtggatacctcagcccccggctccgtcacgtacggcaccactctgtaatccgctctccattgggcaggagtcaccgtacagcggacatagccgcggtaatcgttgaaaaacttaatatgcgggttttgttttaagatctgatccgtatcggcccgtttatccgccccgtttcctccagatgtaatggaagtcccgacgaattcggctccgaaaatttttgaattcgtttgattaaaatcggtatgcaggtttgacgcccagcttgcatgaacatcacccgtcagcacgatgacattgttcaggtttttgctttttataaaattgatgacccgctcccgctgagccgggtagccgtcccatgaatccatgctgtatatcggattggcggttgttccgaaattccattgcgcgaaaaagatttgctgcgccagcacattccacttcgcttttgaggcggctaaatttccgaagagccattgctcctgctctgtccccatcaatgtgcgcttcgggtctctccactcatcagaaggcggcttattcccgtcgccgttggcctgatcatctctgtactgtcttgtatcaagcacattgaacgatgctaaattgccataagaaaattgcctgtacagccgcatatcaggaccgttcggcaatgacatgcgcctgagcggcatgtgttcataataagcctgataagctgcggccctcctgagcacaaacgcttcaacggattggcctttttcagggataacattggcataattgttttccacctcatgatcgtcccacgtcacgacccacggaaatgcggcgtgggcggctttcagattggcatcagagcggtattgggcgtgacggttgcggtaatctgacagtgtgtacacttcggcgctgctgtgcgtcctgacatttcccgtttttgacacatattcgttcggtccgtattcataaatgtaatctccgagatggaatacgagatcaagcttttccttcgccatatgtttatacgccgtataatagccgtgttcatactgctggcatgaggcaaatgcaaacgtcatggccgatacgtcagcgccgggagcgggcagcgttttcgtccggccgacggggctgagctcatgcccgcttttaaaccggtaatagtacactttattgggcttgagcccgtccgcctcgacatggacggagtgtccgagattcggcttggccatttccgttccgcgtttgacgatgtgacggaaatgttcatctgcggcgatttcccattttaccggcacggcctgcttcggcatgccgcccccattcagcgggtcaggggcaagacgcgtccagagaatgacgctgtcagacagcgggtcgccggaagctacgccgagggtgaacggatagtttgaaaatttcggagcggcattcacttcaaacgcgccgatggattgcgcgatcgctaacccgagggaaagaccggcgattttcccggcgccctgtataaatgcgcggcggtcaaacgtattgttctgaaagcttttgttctccaattccttgatccattcatctaaacggccgtcatgtgtcatgtcagttcccctttcgtcttattgatcgcccttattataaaaaagaaatgttaaaccgctatgaagaagtgtgaagggtttgtaaggctgaaaaatgaacggcgggagacatttttcacattgtttcgacaaaccttgccccgccggaagaaaaccccctctgtttctttttggcttgtcatccgtcaagcgcacttttttcctatttttcttcacaaaacattaaaaaaacaccgttcattttaagaacggtgcccccgggattaaaatgtattgtacacgttttcgcacgtctcacctgtcggctgatagaagcagtgggatctgaatctggcgacaaacggctggccataccaagtctgcgggcagttgcccggcggcttaaagtaccacagactgaacttagccggccaaaaccgttctccgttaatgttcctgcgggcaagcctccgctcggattcacgcggtctctggtaaaagtatccgtgagtcaccgcttcaaacgcgtgcggctgaaacaccatctgcctgatggtgcgcaggcctttaaaatcagaacaattcgcccgcacccgattgattcccacattgccgaccaaaagcattccctgcttcccttcgccttccgcttccgccctgagcagccttgccattagatcgacatcggcgctcgacgcttttacgactgccatcatgacacctcccgtattttctcctttcatcatattcagcagcggcccagtgatgacagccaaaagccagaaaacaaatgttcacgaaaaaagggtttatatttcacgttatgaggaaacatactaacatgatttccataaggaggaattcgaatggaacacattaaagcgcttgccattaaaggcattatgaccatcattattctgtatctgatactcggcttaggttttcgctttacattcggtgacgtgctgctgatgaccattgtgctgggagccgtttcctactttacgggcgacctgtacgtgcttccgagatggaataatatcacggcggcgtccgctgatttcggaatcgcgtttcttgttgtctggctgatgggaatgccgctgtccatgggcatttccggaggaagactggcgtttgccgctctcatttccgccgtcatcatcgccgtcggagaatattttttccatatctatctgatgagaaaagacttgggagggtcccgttttttagaaccccggtccgaataatgtaaaaaaggccggataacggccttcagcttgtagagaaaatgatgttttttctgcaagcttttttgttttttgctgtttctttacatatgcccagccttgcttggctgggtatgcggcaaccttcaacatcattttgaataagatcagcggatcaagtgaggggcggcctttattttcgttgcagtaaggtttgaccttttcaacgataaaagagaagtctatgtactgatcaatttttcgaagcaggtgatcctcttcaacgagttggtcaaacagaacgaattcggctgtattttgagaagcgtctcttgtgcgggtcttttattatatgacaggggaatggatattttaagggaaaaataaaggctgtcgagattttctagacagcctgagccccttaaagggggctttttatttgtaaagtaacgctttatacatcttgatataactgataaacccttttcagccttttttcgagctgttcaaaatgaacaaagcgggcttctctcagaaactcagtcccatcaatgaacaaaagaagcacggggacagtgaagactgaaaatctgccggcaacctcttctacctcgtcagcgttggtatgccccaatttgatattcggaaactgatccaaaacttttctgagctgcggcagaacagcgtgacatactgtacaggcaggtcttgaaatgtagataaaactgaattgatgctgcttaataaaattctcgatagaatctaatgaatgtaagtctgtcagctctttcatcaaaaccctccttcaaatcggctcgtctttcatgaccaagctcatcaatactcgtacattcactatacacatttatattgatcatatccgcttttttgcgattcagagcaccttaacgtcgtgcttgaaaaataaaagaacagttaccgcttttcagtaactgttcttagatacttatattaaaaatgcaaagcgtaagctcctgaaccgatgagtgcaactccgatggagactgcaatcagcaccacgttatattcaaaaccgccggcaccgttcgcaaaccctttcgctccatgaacttttacaatggcacctaacataatgatcgttatgatagcagctccaagcgggaggaatacacctaaaataaataaaattccgcttgcgagttccccgagacctgataaagcggccgcggcattgcctggtttaactccaattgactcgaaccattgtccggttcctttaatcccgtatccgccaaaccagccgaataatttttgtgatccataaaacagaaacaccacaccaatcatgattcgaataagtaatagtcctgcatcttccatttttatctctcctcatctttgatttcatctgattctttgctggacggtaccatccagcaatcatcaattgactatatgtttctttattttttatgtgtcaaatcaatctaattctcttacttcaaacggcagcagcccttgttcaatttgtgcccggtgcggttcatactgctcagggagcatcaattttccgcccattgtttcttgtgactcatcatgggcaaagcccggcggatcagttgcgatctcaaataagatttccccatgttctctgaagtaaaccgcattaaaatagtttctatcctgaacaggagtcacaccatatccgtgcgcagcaatgaatctttgccaatctaattgatcttcgtcatcctgagcccgccaagcgatgtgatgcactgtgccgacacccatttgtccgcggccgatcggcgttaatttaagatcaatcacattcccgatatcaccggcagaacgataacgaacgaagtctccttccttgccgactcgctcaagccccatgatgttttccagcagttcacctgttttttcaggctgtgctgataacagggttgcaccgccaaagcctttaatggcaacatccggggttacatctccgaaagtccacgtattggcctcccctgcttctctttccacgatttctaaatgcaggccatgcgggtcatcaaattctatatattgttccccaaaacgctcgatttttgtgtatggcacgttgaacttttcaagtctcttttcccaaaacgccatagcacctctcggcacgacgtaagatgtcacgccaacctgtccgtctccaatgatgccttgacgggcgtccgcccacggaaagaatgtgatgattgttcccggcttcccgccttcatccccgaaataaaggtgatacgtacccggatcatcaaaattgaccgtttgcttgaccaatcgcagccccagcactccagcgtagaaatcagcattctcttgagggtggccgacaattgctgtaatatgatggattcccatcgtttttttagccatttttatgcgctcctttataaatatttaaatatactccacaaactcattcacaggctttcggtagccgcgcggccttctgctttctattttttctttcccgattgtaatcatcatgacgacctcaaattgatcatctatattcaaaatctgtttcacggcttcaggatcaaaccctatcatcggacaggtgtcccagcctttttccttagcactcagcataaacatcatcgcagaaagtgaagcatttcttatcgcctcatctctcttaaacagttctcccctgttttcataaaacgaaacggtgttttgaaccatgtgatcatactcttgtttatttaatacccccagcaccttcaatccttcatagatgtcagccgcttgctgatatgcctgcttatcccctaaaaccaaaagaaccgctgatgagctgaacactttatattgtccgtttgcggcctgcttcagcttttcttttacctccgggtcaagaaccgtcacatattttgtatgctgcaaattaaaagctgatggagccaacgcaaccaattcaaacatttcgttgagctcatctcttgtgattggatgttctggaagaaagttgcttgcagatcttctttcattcaccagctgtacaaattcagccatttctctcgcactcccctttatctcgaattcgagatattatggtataaaaaatcaaataatgtatgatcaaaaaacaaaacgatcggcaggttcttatcctgcactctaattaaattgtctcgaattaaaatatcttgaattcaggataataataaaagataaatactcaaatgtcaacagttcatttttaaattcagcgcaattttgtttatgtactatttagccctgctccaactttttttctgtcaccttatttattagtaaacaggaaacaaccttgctatagacccactcgaaactgaattgatatgataagcaaagtgattacacaagaaaggatacggagagcgaatcaagagcgctcctatttttttgtgcagttttataggaggaaaaaatgacaagtgaaagagaacaaataagcaaaaaagttgctttgattgcattgatagccaatctgatcttaatggcaggaaagatcttttttggactgataggcgatagtgaagcagtttttgccgacggtatacattctgcagcggatgtcgtggcttcaattgctgtcctggccgtcatcggcatttctaataagccgcccgatcaagaccatcctttcgggcatggcaaagctgagatcatcagcgaagcgattgtaggaatcatattagtgctcgtttccgtgtatattctgatagaagcgatttcgtcctttgttgaaggtccaagcatcccgcaatacagcgcattgtttgcggctctgatatcctacgtggctaagcagatcttatatcgttattcgatcaaacaaggggaaaaatggaacagtaaagcgattatagcgattgcatacgatcataaaggcgatatcgttgcctctcttgccgcttttatcggcgtcctattggcgattatcgggaacacacgcggatggtcctatctgttgtacgccgatgcaattgccagtgtcatcgtggcgtacctcatttttaagatttcaatggaattaatcaggccgtctgttgacgttctcatggaaaaaagtgttgatcccgaactgatagaggaatataaagcggttattttggattgccctcaagtcaaacggctcgataaaatccgagcaagagaacacggccactataaattgcttgatgtccggttatctttggatcatgatttgacgattaagcagggacacgatatagcccgggaaatccgaaatgaaatcaaaagacacttttcagatgttgaagaagtgctcatccatgtgaatccttattttgaagaatgaaaaagcagcttgtagagaaaacgatgttttttctacaagcttttttgttttgtgctgtttctttacatattcgtttgatttcactgatccatatgctttctgataaaatgcagcagcgtgtttccttgagcggtcaatatgacgcccttcgcgctgcacttcggacagggcgtcccttctttctcctcgccggttccttcacaatgcggacatgtgagctcaagatcgtcggttgcgatcaccatgaatatccctccttttttgattgtctgtccgtctccagtcactttccatggccatcacctccttaacaacgcaaaaaaaccccgtccatcaaaggacgaggttttcgcggtgccacctttattaacggctgaagagccattctctcaaaaagtacagaaactcagggtttcaatactcctatcttgataacggggaaagaatcccggcaccgcctactgttatttcagcgcagcaattcagaagcccattcggcaccggacggggatcggttcacagcggccaccgactctctgaaccccgcgcgctgatgcgtacttactcttcctcagcattgttcatccgttctatgattttaaaatgtatcatacgctgtcatccggcggaagtcaataacctttcggatcggacagtccgagcatgtcccgcgccatttgcatatgctcctcttgccccgtctgaagcgcgaacttcgccgtttccacagggtaagcggcctgccattctgacacatgctcctgcattttcggccagacgcgcccgccctcagcttcgtagctcttcatcagccgttttgtttctttttctcctaatatcacttgataaaggacaaaatccttggccggatcggcaacctttgcctccgtccaatcgaggagacccgtcacacgctgattttcgccgatcaaaatatgcggaggatgcaagtcgccatggatcagcgcagaaaaatcaggccagtacgagctgtcatttatccacgtttgccatcttttccaaagctgttctgaaaccccgatttctttttttatatgatccattgattccgccgccctttgcctgacgtcatccggttttatgatttcaattccggatctggaggccgcatccgtgtctgccccgtgcagcccggctaatgctgcggcaagcgagccgacaaaaccgtctgaaggcggctcgtgttccatattccagacatactgtttcttatccagatcaattgcggcagccggtattccgtccagtttcggataagcgatcagttccggtgtatgaatccgccaatcggggactgatacagcggcatggctgcggagaaacgcgagaacatcgctttctgcagccgctctttcgataacatcgggacggcgcggctttcggagcacccatgtcacgccgctgtcatcttcagcaaatacgacttggaagtccatacccgtttcatttatgtccgccccttcatattttaaccgtaagccattttcctttgcgatgttcaaaacggattctatttccctttgtttttttgtcatcttgtttccccatttcccttattgactgacacagagcttcgcctttaggcggagaagaaagagatgtgtgaagacgccaaaaagagggcggcataatcgccgccccctcactattactgtcaggttccttattcaggcagacaatcccggtttcctccgcgctcaaggcagagactttgacactatttcattagtgcgaaaaccggaatttgatcagccatcaggatccctccgttccttcttagttaacattattttacacaaaaaccttatatacgtaaaccctatttatcagcttaccggctgcctccgctgacaaattttgatccttcgcgtaaatctttcgcctccaaaaaaaagacgtgaatgaattttttcatattcactttaaccggagaaagcggcacggtttccttggcctgcatttctttcattctcttgctgacagcggggaaatcaaagaatttcgaggcgtaatattcaaatttggggtttgaaaaatcagttgtgcccaatgaagcgaaatggtttaacgaatgaatgacggcccttctgatccgctgttccgaggctttgatttctctgttaacctcggcttgtgccgccgcaggtcccagcttccggatggcggcgtttgtaaacatctgctttaaagacgggatgtttctttccgcctgttcatcctcaaataaatagtgaaggacggccatgaggtcatgcgccccgctttctcccacgatgcctaattccgacaaaagaaattttcctgtttctttgattgatttctcgtgcatcccccccggcccgctttttttcggctcattccgctgaataagacggcttaacgagtgttggatgtcgccgatcgaggtttccagttcaatccgctcttttacttttcgcaaaacggtgacgatctcgattttgttgatcggtttatggataaagtattcgatgccgagagaataagcttctcccaccatttcctttgcctccacctgcgatatcatcactgcttttccgttgtacgccccctgaagatgccgtatcgtctcaatcccgtcccggcccggcatcagcagatcaattaataaaatatcgacttgtttgaaatggagataatgcccttcaatctggcttccgtcctctgcctcaccgacgacttctcctaagtcctcgtcctcgatcatctgttttaaaatggaacggatcgcccggtcatcatcagctataaaaaaacgcatattatgagttcatcctttctgcaatcaaatgcttcaccggcagcttaatcgtaaatatgacgccttttggcttgttatgaaaggaaatgtctccgtcaagttcggttacgatttccttcacgtatgaaagcccgatgcccgttgaaggtgcgccgaattcatcgtatttggacgtaaaaccgggatcataaacgacctctccgattttttccggaatgccgggaccgtcatcttccgcctcaaattcggccatcccccctccgccctgcgcagcgcgaggcggatctcacccctgtcacccatggcttcgacggcattggcggtcaggttatttaagatcgacaggacggtaaagacgtgataatcggggtgttctccttcaatcacgtttttgaattgaatgtctttgcctaaagattcggcgtatttttcattgatgcggataacgaggccgaccagatcggcggcattcatgtaatcccggaatctctcatttgaaatcagcttcgacaggccggcgaatattcgctgattgtcttttttcacttcatgaatttctcccgcaaggcgcagcattcggctcccgagctcccggtcgttcccgctcatttcccgatacagctgataggattctttcgtcacatgctccgtcgttttcagcgtttttttcagatgaatcgtttcttcatataagttagacacaatcatcagcatgtgctcatgctgctttctcgtttgtttttccctgacctgagattcgtgcagcttcatcacgttgaaaaaactcagcacaataaatgtgtgagaaacagcgataaccgcaatatccgccagcttgtccggcatcataatctgcttgccgccggaaaactgaaccgtcatttcaacggcatcggacgccatttcaatgagaaaaccgagaaacccgatcatgagcggccgatcccaaaaaagcctgaccttcagcacataaaacaaacaggcatatgtaaagtaaaaaaagaaactgggatattggctgaaaaaagccgccgtaaatccggcatgctctccccccagcacgccaggccgatccggaatcccacaacggctgcacctgtcaacagccctgacaataccgccggcacatgccgaagcagcagaagaaaaaagaaaaaagccggggcgccgaagctgatccgatatacctcattcagggggtaaaatttcagttcccccgccagcggcacggtgatcagcataagagcgaaaagatagccgtcttttttcagtaaatagtcgagcctgatcataatcacttccttcttctgtctattttgaacaagaccgatacagtccgcaaatttctttagacccgaatggcgggacactccggctgatttataaatctatcggcttattttaagaatgattttgtcgtattttgtatgattctgtagatgtcattatacattaacatggaacacgctatttttgaaaacgttttccaagaccggtttccgcttcggacaggcttgcaatagaggaggaatgttatgaaagatatggtcagagagcgccttgaaaaagaggaactggcttcacttttacaagattgggtcgagcattaccgaccgttttccgtcaatggaaaaagcgcaaattatatacccgccctcggagaaatcaacgactctcagctgggcatttgcatattagagccggatggctcaatgattcatgccggtgaatggaatgtgccgttcacattgcagagcatctcaaaagtcatcagctttattgccgcatgcatgtccagaggcattccttatgtgctcgatcgtgtggacgtggagccgacgggtgatgcgtttaattctatcatccggcttgaaatccataaacccgggaagcccttcaatccgatgatcaatgccggcgccattaccgtcgcctcgctgcttccgggtgaaacggcgcataataaattagaatatctcttttccgtttttgaaaaattaataggaaaacggcctcacattcacgaggaggtcttccgttctgaatggcagaccgcgcatcggaacagagcgctcgcctactatttaaaagaaacgaactttctcgaggcggatgtggaagaaacgcttgaagtgtatttaaagcagtgcgccatggagggtacaaccgaggacatcgctttaatcggattgatacttgcccatgacggctaccatccgatccgacgggaacaggtcattccgaaagatgtcgcgaaactcgccaaagccctgatgctgacgtgcgggatgtacaatgcgtcaggcaaatatgcggctttcgtcggcgtcccggccaaaagcggggtatccggcggcatcatggcattggttcccccaagcgccagaagagagcagccttttcataacggatgcggcatcggcatttacggtccggccattgatgaatacggcaacagcctgaccggcggcatgctgctgaaacatatcgcacaggagtgggagctcagtattttttaatcaaacgaaccaagaggtgattggatgcaggaattccttgaaaatgtaatcggctcggcaaatgattttttatggtcaaaactgttaatcgtactgcttctttctctgggactgttttttacgttcagatcaaagggtctgcaagtccgcatgctgaaggaaatgatccgggttttgaaggaaggcgcggccgcccggacaaaaaacagcatttccccgtttcaggcattttgcatcagtatggcggcgcgtgtcggaacagggaatattaccggaatcgccattgcgatcgcactcggcggtccgggcgctattttctggatgtggattatcgcagtcatcggttcggcttcaagctttgttgaaagcacgctggcccaaatttataaagtaaaagatcaaaacggattccgcggcggcccggcctattacatggaaaaaggcctgaagaaacgctggatgggcgcgctgttcgccgtattaatcacactgtcattcggggttgtttttaattccgttcaatccaatacgatcagcgtcgcctttcaaaacgcgttcggcaccagccggcttacattgggcattattttaatcttggtttttggcggcgtaatcttcggcggcgtcaaacgaattgcgaaaatggcggaatacatcgtagtcgtcttggccgttttatatatcggtgtcgctttctttgtcattctgacgaatatcacccaattgcccggcgttctgtcgctaatcgtaaaaaatgcgttcggcattgatcaggcagcgggcggcgctttaggtgcggccttgatgcaaggtgtaagacgcgggattttctcaaatgaagcgggtatgggaagcgctccgaacgcggcggcgacagctacgacgagccacccggtgaaacaggggctcattcaggcattcggcgtcctgacggatacgctcgtcatttgtacaagcacggcgcttatcattttattttcagacgcttatcaccagccgggactgagcggcatcgcgctttctcaggccgccttgagcgaccatgtcggcgcgtgggcgtcaggtttccttgccgtcttaatgcttttgttcggcttcagcgctctgatgggcaactattattacggagaaaccaatatcggatttttaagccagaacaaaaagtggctgttcatttaccgcatctgcgtgctcggaatggtactgttcggctgtatttccaaagtccagcttgtgtgggatatggctgacttgttcatgggcttaatggtggtcgtgaacttaatcgcaattttccttctgtcgaaaaaagcatttgccgctttgagcgattatgcccggcaaaagaaagccggaaaggaccccgtcttttacagagatgtgctccctgatgacgacgggatcgaatgctgggagtattcagatatcgcgaaaagcgcgaaaggcaaacatatttcctaaacaaaaggtgttcaggcagcgtcctgaacaccttttttccgccggttcattgacaaagagaatagcgtccattaccctttttatatattttcagtaaagtcagaaaggaaggcctatgaatcccattacacaaatattaaatgaatacccggttatgatcatagacggcgcgatggcaaccgagcttgagcggatgggctgtgatttacatgacgatctgtggtcggccaaaattcttttggagagacccgaactgatcaaacaggtgcatgcagaatattttgccgccggcgctgattgcgcgatcaccgccagttatcaatcgacaattgaaggatttgcagcgcgcggcatcccggaaaccgatgcgatacgtctcattcagacatctgttgaacttgccgcacaagcacgcgatgaattttgggcgcatgaagaaaaccgtttacaccggcctaaacctttggtcgccgcttctatcggaccttacggcgcgagcctcgctgacggctctgaatatcgcgggcattacggactgacggaagatgagctgatcagctttcaccgcccccggatgaaagccctcatagaatccggcgccgatcttttggcctgtgagaccattccgtccctgtcagaagcaaaagcgatcacaaggctgctggaggaattccccggcacttatgcatggatcagcttcagcgccaaagacgggcggcatatcagcgaaggcacgcctatttccgaatgcgcggccctgcttgactcctgcagccaaatcgcagcgatcggcatcaactgcacaccgatcgaatatattccgccgctgatagaagaaatcaaacgggcagcatccaaaccgattatcgcctatccgaactccggcgaacaatatgacccggtgacaaaaacctggaaaggcgcagcgtgcgaaaaccatttcggaaaaagcgcgcaaagctggtacgaaaacggcgtgagcctgatcggaggctgctgccggacgaaacccgcggacatccaagccattgccgattgggccaagaccttaaaaacaacttgactaatcggaatagtttgtatattctattcaaaaagccggttcgccggaatctcgtgccgttcgccggcatgagattttttattagaacggccctcgcagaaagttggaaaacaatgaacaacaagaacgagacgaattttcagagaagtatgaaaagcagacacctctttatgctatcactcggaggtgtgatcggaacggggctgtttttaagctctgggtataccattcatcaggcgggtccggcgggcaccattttcgcttaccttttgggcgcgggcatcgtctatcttgtcatgctttgcctcggtgaactgtcagtggccatgccggtgacgggcgcattccacacctatgcgaagacctatatcgggcccgcgacgggctttacggtcgcatggctgtactggctgacgtgggcggtggcgctgggctctgaattcacggcggccgggctcttcatgcagcgctggttcccgcatacttcagtttggatgtggagtgcggtattcgctcttttcatctttttattaaacgccttctccgtgaaattttttgctgaatcggagttttggttctcaagcattaaagtcttagccatcttactgtttattttattgggcggagcggcgatgttcggcctcgtcccgatgaaaagcggtgaggccgcacctatgctgtcgaactttacggatggcggcagcctttttccaaatggctttttcccgatactgatgacgatgctttcagtaaacttcgctttttcagggacggaattgatcggaatcgccgccggggaaagcgccgatccggaaaaaaccgttccgcgcgccattaagaccacagtctggcggctggcgcttttctttatcggaacgatttttgtgctgtcagggatgatctccatcaaggaagccggtgtgattgaaagcccgtttgtcacggtatttgacagagtcggcgtgccttatgcggccgatctgatgaatttcgtcattttaacggcgcttctgtccgcggccaattcagggctgtacgcgtcatcacgtatgctgtggtccctgtctaaagaaggggagcttcatcccgcctttgccaggctgacctctaaaggcattccttttaacgctctgatcttcagtatgatcggcggcattctgtcgttgttgtcaagcgtatttgcagcggatacagtctatcttgttctcgtctccgtctcaggatttgcggtagtggctgtgtggatgagcatcgccgcatcacaatttttgttcagaagacgatttcttaaagaagggcaccagctttcagacttgaaatacaggacgccgggatatccggccgtaccgatagcggcctttctcctatgcctcgcctcctgtatcggcatcgcttttgatccgaaccaggccatcgccctttattgcggaattgtatttatggccgtttgctacaccgcttattacttgaaaaaccggaaaagcagagcccgcgtgcaagccgtaaaatcccaataaccaaaaaaagaaccctgcggcgcaagggttcttttttcatttatacttcaacgacccatctgaacgaatcccgcaccttcccgacttggatgccggcaatcgtttcatagagcttttctgacacttcaccgatcaaaccgttattcagctcaatcgtttctccgtgaatgtgcagcgcgccgaccggcgagatgacggccgcggttcccgtaccgaatacctccgacacctcgcctctcattgcagcctcatagatgtcatcaatggcgacctgttcttccctgacacggatgccccagctttttaacagctctatcacagatgcgcgtgtgatgcccccgagaatgcttccgtttaacgccggcgttacggcctctccgtttatgatgaaaaagatattcatactgcctacctcttcggcatatttcttttccactccgtcgagccaaagcacctgatcataccccagttcttcggctttccgctgagcctgtaagctggccgcataatttccggacgttttgacgtcgcccactccgccggtgacggcgcgcacatactcatcctccacataaatacggatcggtttcagctgatcgccgtaatacgaaccgaccggcgtcaaaacaaccatgaacttgtaacgctttgaaggccggacgcctaaagaaggctcagtcgcaatcacaaacggacggatatataaagaggttcctttttctatcggtatccattcctgctccagctccaccaattgtatcaatgcttccagcgccagcttctcgtcaagaggtggcatgctcatccgccgtaacgatttattcagccgttttatattttggtcaggacggaacatcaacacccgtccgtcttctgacctgtaagccttcagcccttcaaatacggcctgcccgtaatggaaaaccgatgcggaaggatccagatggaccggttcataaggtgtgattctcggatcatgccaccctctcccctcttcgtaatccatgacaaacatgtaatctgtgaagtacttgccaaatcccaatgaagcggaatccggtttttcctttctagctgtgaccttacgtctttcaatcagttgattcaacaaaagcacacctttcttctaattgttcaaattttcagtcttttctgggctgcatgttttttctgtcccgaatcttgtatgcacagatatatgagaatgcagttgaccatatcatatcaaatataccacttataagaggataattatcaaaatttttaatattttcagcggaaatctttctttattcttatgctccttcatttttttcaatgaggactttctgtcatattcaatgattgcgcttacataatgtaaagcaatccttcctttcgcacagtcaatcatgtgacaaatttatggcggacaggaaggtggttgccgcctgcttcacgaattacgtaagaaatgcgcaagtaaaagggggattcgcttgaaaaaatttatcgcattccagattttgatcgctttagccatcggagcattgatcggccatttcttcccggatttcgggatggcgctgcggcctgtaggagacggatttatccgcctgattaaaatgattgtcgtgccgatcgtgttttcgaccattgttatcggagccgccggcagcggcagtatgaaaaaaatgggcagtctcggcatcaaaacgattatttggtttgaagtgattacgacgctcgttctggcgctcggtctgttattggcgaacgtgctgaagccgggagtcggacttaacctctctcatcttgctaaaaaagacattcacgagctttccggctatacggaaaaagtagtcgatctgaaacaaatgcttcttgatattatccccgttaacatcattgacgttatggcgaaaaatgatcttctcgccgtcatttttttcgcgattttattcggtgttgccgcagccggcatcggcaaagcctccgcacctgtcatgagtttcttcgaatccacggcaaatattatgttcaagctgacgcagatggtgatggtcaccgctccgatcggcgttctcgccctgatggccgcctccgtcgggcaattcggaatcgcgcttctgctcccgatgctgaagctgatcggcactgtgtttctcgggctgttcctgatcctcttcgttctgtttccgatcgtggggcttatctttaaaatcaagtactttgaagtgctgaaaatgatttgggatctgtttttgatcgctttctccacgacaagcacagaaaccattctgcctcagctgatggatcggatggagaaatacggctgtccgaagcgggtcgtctcctttgtggttccgtcaggtttatcgcttaactgtgacggttcaagcctctatttatcggtgtcctgtattttcctggcgcaggcgtttcatgtggagatgccgctttctcagcagcttctgatgatgcttgtgctcgtcatgacaagcaaaggcattgccgccgtcccgtcaggctcactcgtcgtgcttctggcgacagcgaatgccgtcggtctccccgcggaaggcgtcgccatcattgccggtgtcgaccgcgtcatggacatggcgcgaaccggtgtcaacgtgcccggccatgcggtcgcctgcatcgtcgtatccaaatgggaaaaagccttcacatataaaggacccgtcacggcagatcagaccgcccggacagaaagtatgtaaacacaaaaaagaccacctcattggtggtcttttctattaatcaatcgccgcatgatcctctttttcaatcaaagcaaggcgttcattgatttcttcctgagtcatttcgtgctctttcacatacatgtttcgttcgttcgtacggcattcgtgactgcagctgcgcatgtatttgtattcattctcaggtgtgcagatcatttttttattacatgccggatttgcgcagttcacataacgctcgcacggctcgcccgtgaaataatcttttccgatgataacgtgctctacgcggttgaccggtacgctgattctttcgtcaaacacatagcactgtccgtcccacagctgcccttgcacttcaggatctttaccgtaagtgacgataccgccgtcaagctgggacacgtcttcaaatccctgcttcagcagccagccggaaaatttctcacagcgtacgccgcctgtgcagtacgtgaggatttttttgccttcaagcatgtctttgtgttcttcaatccagtccggcagctcacggaacgcctcaatatcaggtctgaccgctccgcggaaatgaccgaggtcatactcatagtcgtttctggcgtcgatcacgatcgtgtcaggatcctgcatttgctcataaaagtctttcggtttcaaatgcttgcccgtcgtgacattcggatcaacatcatcttcgagacgaagcgtcaccagctcttttttatggcgcacaaacattttgcggaatgcatggccgtcagcctcgtcaattttaatcggcatgtcggcaaaacgcggatcagctttcagcgcattcatgtattgttccgtctgttcaaccgttccggacaccgtgccgttaatgccttcctcagaaatcaaaatacggcctaacagaccgagctccttacaaaacttcaaatgctgagccgtgaactcttcaggctcatcaatctttacatatttataataaagtaaaactctatattgtttttccatgatttatacaccctgttcaattatattaatgatcacgcacactatactatatcatacaggaaaacgggcgaaagatgaacatttccgtccgtactctttcttccagtcacgcttcgccttttaaaacctgctgaaaataaaaccgatacgtattgcgcaaaaaggtctcaagcgaaaggccggccgcggtctgatacttgccgataataaacggaaaacggtcacggccttttgcccgcagaagatccgcgctgtcttcagccagttctgagatgagcgcctcaacgacaggccggcatgcatcccgcaccgcttcaagaatttgctgatcgcctgtatgccgatactgttcgatcagctttcccaaatccttttcttccataaagttcacttccttacaccatataaaaaagaggagcagcttttataaagcggacgcctcctcctgtgactccgcataaccgatgatctgaccgacctgtaattcacggccttcagtcaggttatccgaaggggtaaacatatctttctcgaatactaaaataacggtcgatccaaatgaaaaatagccaagctcttcccccgtctcaagccggtttccggtgtttgtctgaacgatcgagttaatattcatcgcacctaccggaatcatgagcatctgctgatcagcacgggtcagctcgtacacataacggtaattttttgagagcacatctttcccgtactttaaccccatcgtattaacgggataggagcgtttccccagctcggccagctttttatacgtgcagctgacgggagaatggaagcggtggtaatgtctcgggctcaggtaaagcacggcaaaacacccgccgttatacttgtgatcggcgcttttaaaccccgtcagttcggcgaacgaataatccttcccttttaccatgaaagtttgattgggattaatcatgcccaccgtctgaacgacgccgtccaccgggctgacgatggcgttcttctcttttgccacggggcggagattcaaattaatatcacgaatgaaaaatgacgccagtgaatcaaagtcagaagccgtgcgttccgtttcattccagttaatgcgatagtgtttggaaaacagcggaatcatcggcttgctcagtttcgattcacagaagtttttaatgagataagacgtcaatcgattattagtcagttcaatcaatgaacggtaaagaactttagcggcagtattaaacattgattactcctatgaattttcctatagtaataaaaataaaacaccataaaaacgctccgatggcggcgaagcataagtaggttttgaattccattctgccgattccggaaaagtagcaggtcacgtgtctgatgccggggatgaaataacctaaaataatggtgtacggcccgtacttcttcatccacctgtctactttctccatcctcttttccttcaggccgacccatttcccgaacttattaataaacggccggccggcttttctgccgatgaagtagctgataatcatcccaaggagcgctccgataaagctgatcagaatggagagcccgtaattcagcacgtttaaatgagcgaagtagcccacaagcgtcatcatgacttcatccggaataggcaatccgataataccgagtgtcagcataagaaaaatcgcgatatatccgtaatcggatattaattgctgaactaattccatcttctgctctccaggttttcaggcgcctgttttttaaagtgcggaaatttaatgttgctgaccattaaataaccgagcgcgatcgttcccgcccccagaagaaaagcgttattgataaagctcaaaatgacaagacacatacccgcaaacggaatcggcatcccgataaacgtcggcagcttgctttgttcaatattaaatctggaaagacggatcatcccgcagatgctgtaggaaagcgcgattaaaattccgatgaacggaagcgtatatagtgaaacactgtaagcgagcatggacggcgctacgccgaacgtcacgagatcagcaaaagagtcaagctcccttcccatctccgataccgcgttcagcttacgggcggccaaaccgtcaaagaaatcaagaaacatcccggtgaaaataaagatcaccgcagagtgtatattatgatacaaaagggaatgaatcgataagagcccgcaaataaaatttccaattgtaatcatactaggtatataattcacagtttacacaaacctccaattaaaaccatatcaaatcggactgcgtatgcataaagactccattttacggaaacataaaatgaaatcctttcaatgctatcattcaaattcttttattatacagcatttggtgttatttgaacaatctaatctggtgatttttgttttttcgccgttcatattaaggtaagcaatcatggtttcctctattccggattaccctgcttaaatattccatgctgcgatccggattgtccgttcttgatgaatgaaaagccgtatgatgtattgttatttccttctccgtgaaatgagaacattacatataacgattgcggacataaaaagtttcaagaattaaaaaaccggcacaaaacggcctcatacattatctcacaaccccgttttccagtatatagtctgtccaaacaaaaaaggcgccttaccattacggtaaaaacgccttttaagatcattttatgtaattgataaatgactgagtgcttcggccgctctttctctggcctcttcaacggtctcggctgcagaaagcgcaaccgccatacggcgtccgactttcgtgacgggtttaccgaatacgcggacctgagtgctttttaccgccaaagctttctccaaaccttcaaccgcataatcagcaagctctttgggcgccttcagcggacggcttgcccccggcgacagctgaatgatttccggaatcgggaatcccaagaccgcgcggacatgcagcgcaaactctgacaaattttgcgtcacaagcgttacgagccccgtatcatgcggacggggagacacctcgctgaaatatactttatcttcagtaaggaaaagctccaccccgaacaaaccgtatccgccgagctcatccgttatgcttttcgcaatgtgtttcgcctcttcaatctgctgttccgtcatatgatgaggctgccatgattcaatatagtcaccgtctttttgttcatgtccgatcggcgcgcaaaaggacgtaccgttcgccgcgcgcactgtcagaagagtgatttctgattcaaacggaatgaattcctcaacgatgacccggccgtttttcacccggccgccttccattgccatgtcccagcagcttttcagcccggaagccgagcggcacacgctttgcccttttccggaagagctcatcagcggctttaccacgcacggaaagccgattgtttccgccgcttctttaaattcttcgtatgtattcgcgaattcatagccggcagtcggaagatgaagcgtctctgctgcaagccgtctgatgccttcacggtccatcgtcagctttgccgcacgcgcattcggaatgacgtgaaacccttcttcctcgagcttcagcagctcatccgtcgcaatggcttccacttccggcacgattaagtccggtttttctttctcaatgacttctctgacctgcgctttatcaagcatatcaatcacatagcttttgtgtgcggcctgcatggcgggagcatgctcatagctgtcaacggctacagtgacaaccccgagccgctgcgcttcaatgacgacttctttccccagctcgcctgatcctaataacaacatcttcttcgcctgatacatgtcctttggcccctccctttctataccccactcattataacggaaatattcaaaaaataaagacaagacagattacaagctctatcctgtcttttgtgctgattcgagcgattcaatcgccgctgacacgtccttcccgcaatattgccccattaagcataacgattcttccgcccggcaggcgtgagaagcgatgcggcgctttgcttcctcatggttgtcaaggatgccgagagcacagagactgacggggaaaccgagccggcggtaaaacggaagcagctcttcaatctcatgtctccgattctcaagcgcgagctgcaccaatatgccgtaagcaaccttctggccgtgcagcacctgatgtgtctcctgaagaaaactgaggccgttgtggaccgcatgcgcccctgccatcctgcacaaacggccgccatacccgccgaccgttctcgcaagcataatgatcgtttccgccgtatggatgaacggcacggacagctcgcctttctccatgcttacgacggcggcttcactgtaacgcaataacagattacgcatatattccgcctgtctcagccccgcctgcgccatcagaggcggcgcttcctccgtatttctgatgaccgcctcggcctcataccatttcgccagcgtatcaccgatcccgcttttcatatattcaatgggagaggaaagcaaaaacagcggatcaacaagcgtcaaatagcttgaacgcttgtgataatcaactctgataaaattgccgctctcatcatatatgacactcaacggcgtacttgccgcacacgtccccgcaatggaaggaagcatcacagcctcaatatcaagccggtctgccgccgcttttgccaaatccaaaatcgtgccgcctccgataccgatgatcacatccgcgtcttccgcctgcccgcagaccttacgcaccgcctcaggtgaacagtatcctttgtgctgaatcacatcccaggaagaaccgccgccgtaatcggagaacgcctgataggatttgattccggtcacaataacgggttttctgaatgtctccagcagccccggaagttcttttgcgattccttccttgcatatgtactgattcgggccgcttcggacgatatcttcaggcttcattcgaatctctcctttggctggaatttatacatattttctcacttgtcagaaaatacatcaaccggaggtgcgtcagcgcttcgcttcctccgcctccaaaaacagctcatcaagccgctccaaagcttctgccttttcaaaactgctgaaccacagatcatcataagaatcaaggatgcggtaatgatgggaaatcaaatgctgctgcaagcggaactcgccttttttctcgatggctttccaccacaccttgccgcccatcgtcttccccttcggcctgtcaattgtgcggtgagcaaccgtttcaatgacctccagcggatcatctcctaatacggattgcagtgtttcacttgatctgaaaagcgcgcaaaccgccacaacgtgcggccattccgcaagcgcccgccctttctcaatctgcaccagcgactttttagaaaggccgatcacatccgccattttctcctgtgtgtagcctctctccgaccggattttcttcagctggactgagacaagctcagtcatataatcttgatccatctcaacctccatttttatcaatatagccattttacaccgcggcacgccttttttatatcagaacattttcaaacaaatcaaaaggacccgggatcggcttttcattgaaacgatgtacctttccgcataatccagaatgatgcggtgaatacaaacgtacgcccgaagagacagatgcggtctccctggcggttgagctccggagaaaataaaaagctgccgcagctgcggcagctaaaacattataagctgaaaatcaaaattatgaagcgaatacaatccaactcgcactataattgacacgttttttcgaaccttgattgaccattttaaatctgtatgaatctcctttttttaacaaaggtgtttcaaaataagtcgttccatttttctttgcattggcggttttgattgttttccaggcacctttgccgttgacttgcttttgaacgtatattttatacgtgcccttccctttactgttggatttaaaagtcacggctctcaagctgtacttttttgtcgtcttagtgaatttaggatgatatgtattgatcacatagttagtgaaatacccgcttttataagtatgaagccagtctttagcctctgctttttgcggagaagaaaaacccataaaaccaattccgctgattaaaagagtaaaaataatgatgagcgacttaaaaatctttttgcttttcatcgagaaaatccttccttcctgtaactatttaccctatttatgttaatgacaatatagctaatcataaatccgtccaactaaccattttgactgcagggagagatgaaaacagccctgaaaatgactatatgactactacttatgattcttgttatttttgattaagtgataaagttactttaaagcgctatccattttgctgtttttgtatcaattgtcatagagagatcttttcctatcaatgcctctctatcggcgtttgtatgatggggctgtcctcggacaaactcctgcacccatgacaaactgtcatacgtttgccacctatgaatgaacgcacactacacgtaatggagggattgcaatggacgaaatggtcctggaaacacaacaatggctgaatgagacgtacaaaggcagacacgggtacaacaaggtgccggaaaacggaaaaacaggctgggataccatttacggtctgacacgggcgcttcaaattgagcttggtatttcagaaccagccgataacttcggaccgacgacacaaagattgtttaaaccgttgaaaaagcaggctcccgattctaagccgacaaacatgaattacattctgcagggggcgctgtggtgtaaagggtttaacccgggcggattttctggcgttttctatgaaaataccgaaagcgctgtaaaagagtttcaaaaagcggccggacttactaagcaagacggcattgtcacggcactcattatgaaggctttgctggatatgagcgcttttcggttagtagcgggaggcgacaaaagaatccgccaaatccagcagaacctgaaccgggattacaatgactacatcggcttgatgccttgtgacggcttatatgcccgcgatacaaacaaggccctcatctatgctctgcaaaaagaagaaggcatgagcacaagcgtcgccaatggatttttcgggaacggaacgaccagcttatgtcctaccttgactcccggcgattcacggacaggctttgttttgattgttcaatacgcgctttactgtaatgggaaatcatttgaccccggtgaattcgacggaaaatacggcgtcggagttgtatcggcagtgaaagctttccaagaatttatgtgcctgccgcagacaggttatgcggacatgccgacgattaaagctttattatcaagctcaggcgacacaacgcgggctgcttcagcttgtgacaccgctgccattttgacggcagatacggctaaaactttgcgtgagaatggctataagatcgtgggaagatatctgaccgggaatgtgcggactagcagcggactgacatcgaaagcgttaacgtcaaaagaactttccgcgattttcaatgccggcttaagcgtgtttccgatttatcaggacggcggctatgaatcttcttattttgtaaaagaccaaggaacgagagatgcgtacagcgctgcatcagccgcccgaagattaggttttccgtcaggaacgaccatttactttgccgtcgattttgatgcgtatgattatgaagtcacggataaaatcatcccttacttccaagaaatcaagtcagcttttatgaaaatgcaggcgttctcaactgcgccgaaatatgaaatcggggtatacgggccgagaaacatttgtatccggacgtcagaagcaggtctgaccaaatatagctttacggctaacatgtcgaccggattcagcggcaacctcggatacccgatgccgaaaaactgggcttttgatcaattttatgaaggcacgatcggaagcggagcgggaaaagtcgccattgacaaagacggatactccggaaaagactcgggtgcaagcagcgtccatccgccttctgatcccgtgtatgatgcaagactgcgcacactgacggacattttaacaaccattcctgctttagaaaatatatcgaatcttgcgaatgccatgtttgaattcgacaagacagaaaccatttatgcatcacctgaaatggatattcttttatctacttcacttttggcaacagtgccaagcgaaggttctcccaacacagttaccattacaaatggcaaaccgggagcttatattaccggtctgatgggagattcacaagtctcttttacagcatcacaaattgattcgtatcaaaacctgcttaacagtctgagcttgtcagtgcgcaacggttatttagaagtgtatgtcaatccggctgcgggatcgctgaatattcaatttaaaatttatacacctgatattccggtcggtgacagtgctactactggactaacaactaccattacatttaaaataaaacaaaagagcttcagattgccggattccgaagaggtgtactctccggattgggattctgtcgtgaataccatggctattgcaggcgcaggaattattgttattgtagggatcggtgctttagtcgttttagcacctgaattaggaggagctgcagccttgttcagcacagttttatcactatttctataattgaacaggcagctccttgctccaggaatgctcaatgagtattcttggagttattttttaaggaggattcgtatgaagattgatatgcagacatacaaggacaccgttcaaaaaatagaaaatgatttgattccgcgaagtcaaaatgacaaagaactgcttacatatttaatgaaacaagattcgctcacactgaatcaaatgaaaatgtgtttcactgaaccgctcctcaccttccaacatactgtcaaaatcgtatgtacagtcacattcatcacgttatatatcttttttttcagcactcattttaatgatttgattgaaatggctctgcagatggtttttggcctggccggccttgtttggatttttgctgtatttccgttttcaaggaaaatccaagtgtctgaccgtttcagacaaaaatctgaaaacacccgtatcaccggaatgatagactttgtcctcgaacaacgatacaaagacatgatcagttaaaaacccctctgcttaaggggtttttttatgatgcaatcccttcaccccccttatcaaaaaaggctcttcccctttggaaataaccggaacacccaatttcgttttcaatataatgaggtagtggatctgcaaagaaagaagggcgacatgatgggtatcattaatggcaaaatgttcattgaccgattaaatcagctaggaaatgagatttggcttgatggtgaaaagatcgagggacagatttctgaacatcccgcatttaagggccttctggaaacgaagcgctctctttatgatttgcaaacgaaaccggacatgaaagatcaaatgacttacagtcttcccggtaaaaaagaacgggccgggctttcatacctgcagccgaaaacgaaagaagacgtaaaaagaagaagaaacatgttcgaacattgggccagacacacgcacggaatgatgggacgaagcccggattatatgaataccgtgctgatgagcttcgcctcctctgccgcgcttttgaaagaccgtgatcaatgttttccggaacatgttcaagcgctgtacgaacgcgctgccgcacaggatctttcttttacgcacacgtttatcacccctcaggtgaatcgttcacaaatgggtgtaaacgtatcgccgacacctatctcggcaaaagtcgtcgataaaaatgaaaaaggccttatcatacacggcgcgcggattttagccacacaaggcggcctgacggatgaagtgctcgtggtttctctgcctaagatgtattttgaatcggatgaagcgttcgctttttcaatcccttccaatacaaaaggagtaaaattcatctgcagggaatctttcgtactcggaaaatcatcgtttgattatccgctcagctcaagatatgaagaaatggattctatcgttgtatttgatcacgttttggtcccttgggaacgcgtatttttttataataattacgaggcggcttttgattttaatatgaaaagctcttttaacgccttcgcatttcatcaagttatcacgagacaaattgtaaagacggagtttctcctgggcctcgcccaaacgcttgtcgatgcgatagatgtgggggaatatcagcatattcaggccaagatggctgagatcatcaccggtctggaaacgatgaaagcccttttggaaaagtcggagaatgatgcggaaacagacgaatggggttatatgcgtccgagtgtcactccgcttcgcgtggtcagcgcgattttccctgacatctacccgcgcttcacggaaatcatccagctgatcggggcaagcggaatggtgactttgccgactgaaaaagcgttccgttccgacatcagaggagaccttgaccaatatttacaggcggccgaattgaacgctgaggaccgggtaaaagtgttccgcctcgcatgggatttgaccatgagcccctttggaacaagacagacacaatatgagcggtacttcttcggtgaccccgtccgcttagccagccatctgtacagaagctatccgaaagaagaacagaccgcggtcatcaaggaattcctgcacattcataaataaaacaaagcagagaacgcatctctgcttttgatagctggatcggctgccgccgatcctattttttgttttggctgatcaccaccatcgtaatatgcgataacgcgaaagagacgagcgtgtacacgacggcccacccgataaacgagaaattcaatatggtaaaggtgcatataaggcaaacggctaaagcggcagccggcataatgaacgcgtttttaaacaggtacgttccggcgactgacaggatgatgatacaaagcggcagaacaccgaacgcaaaatccaattcatcaatcaacagatgcactcccttcgcttttcttagttcggcctaacacatcttatgcctgagtacaaaatcgagtacatcaaatctttcgcgctccggctgatattccctccggttatttattcaaaaaaatgaaaactttccttaaagcgtttacattcacgccagactgtgataatttaagaaagcgctatcatatacaagttaatgatttttggatggagatgaggagaaccaggaaaccgcgccctttcataagggtgatttctggttctttttgtcattttcaaggaaaggagtcatacatacatcatgatagacgttcagcaaaggggaggatatgatgtttcaattgttcaagccggctccgcatattgagagattggatgattcaaagacggatgcggcctataaacggctcaggctgcaggtatttttggggattttcatcgggtatgccgggtattatttacttcgcaaaaactttgccttcgctattccttattttcaggaacaagggttttcaaaaggggaacttggcttggtgcttgcggccgtatcaatcgcttacggcttcagcaaatttattatggggatggtgtctgaccgctgcaacccgaggtatttccttgcgacaggtctgtttttgtcaggtgtcgtcaacattttatttgtttccatgccatgggtcacgtcaagcgtgacgattatgtttatttttatgtttattaacggatggtttcaagggatgggctggccgccttgcggacggacgatggctcattggttttccatcagtgaacgcggaacgaaaatgtcgatatggaatgtcgcccataacataggcggaggtattctcgccccgctcgtgactctcggcatcgccatgtttgttacttggaaaagcgtatttttctttccggcgattatcgccatcgtcatttcatttgtgattgttcttctcgttcgggacacgccgcaatcctgcgggcttccgccgattgaagaataccggaatgactatccgaaacatgcgttcaaagaccaggaaaaagagatgacgaccaaagaaattcttttcaaatacgtgctgaataataaatttctgtggtatatcgcatttgccaatgtctttgtttatttcgtgcggtacggtgtcgttgactgggcgccgacttatttgacggaagcgaaagggttctctcctgaagattccagatggtcttatttcctttatgaatatgcgggaattccgggaacgattttgtgcggctggatcagcgaccgatttttcaaaagccgccgcgcaccggccggcgtgctgttcatggccggcgtatttatcgctgtattggtctactggcttaaccctgccggtcatccgctcatcgataatatcgcgctgatcagcatcggattcttaatctatgggcctgtcatgctgatcggacttcaggccattgaccttgcgcctaaaaaagcggcgggaacggcagccggcttaaccgggtttttcggctacatcggaggctctgctttcgccaacgccatcatgggttatgtcgtagaccgctttgactggaacggcggctttatcatgcttatctcctcatgcgtgctgtccatcgtcttcttggctatgacgtggaatacaggcaagcgggcggagcatgtgtaagaaaacaacataaaagattaatatttttgcagtacagcatttacaacgattttctacactagagacagatattgatttttaagggggaagaaaacatgcggaaacataagttgtttgctttggtattgctttcattcggtttattgtcattcatcgtcacgcctgtatcggcggcgggaaaaggaaacctcttgtctcctgacagaattttaaccattgcccatcgcggtgcttcggggtatgtcccggagcacacgatcctttcttatgaaactgcgcaaaaaatgaaggctgactatattgagctggatttacaaatgacaaaagacggcaagctgatcgtcatgcatgatgaaaaactggaccgcaccacaaacggacaaggctgggtgaaggatcatacattagcagagattcaaaagctcgacgccggttcttggttcaataaggcctatccggaaaaagcaaaaccgcaatacgccggacttcgcgttcccacacttgatgacgtgttaaaacggttcggcagacatgcaaactattatattgaaacaaaggcgcccgaaacatatccgggtatggaagaaaaactgatcgcctcactgaaaaaatacaaattggcaggtaagcatgcgaaacttggacaagttatcattcagtctttcagcagggagagccttctgaaaatcaaacagctcgatccgaaacttcccgccgtccaattgcttgaagcggaacagatgacctcaatgactgacgcagatttaacagacatcaaaacatatgccgtcggaatcggaccggattacaaagcgctgaacgctcaaaatgtccgaaacattcgcagccacggcctactgcttcacccttacaccgtgaacagcgagacggacatgcgccgtctgctgaattggggcgtaaccggtgtgttcaccaactatgcggatatatttcaaaaggttaaaaaagaatataaatcataaagccagcatgggttcggagatgatgccgaacccatgtttttttgcctgatcaaaaaaccttgcgggaacgttaccgcaaggtttttatcaatcattattcttttccggcagcggcttccgcctgcccgccttttaattgatcgttgattgctttggcgtctttcaaatactcagtcttgaatccgctcttcagcgcccacgcatagaaggcaagggcaacgattgcgatcagccccatatcccatccgtacggaatgatgttcagaccgccgaatttttcacttccgagccatgaaatgaccatcatgctgagcagatagacaaccatccaaacgccgcctttaaagtttctgcggaatcctttccacttcgctttcgcttggtagtagaaataaatcggaaggccgatcaaaatgataaacagcacctgccctgttaacggccagcgcgcccaatacagcacgagagacgcgaacacgaagccgagcggtgcaaccacgctgagtcctttcagacggagaggcctgtacaaatccgccgccgtcctccgcagcgtcattaccgtcacgggacccgtgatataagaaatcagcgtcgctacggaaatgatttcagcaagcacgccccatcctctgaataaaaacagaaagataaacgatacgatcaggttgaaaatcatcgcttggcgcggcacgccgtacagcggatgaagctttccgaaaatgctcggcatatatttatttttttccatgccgtaaatcatgcgtgacgtcgtagcggtatatgtgatacccgttcccgacggagatacgaacgcatccgcataaagaataatgacaagccagttgatattcaatgcgatcgccaaatcggcaaatggagagttaaagttcaggtgactccagccgtgaacgatcatggaaggttcaaccgcaccgataaatgcgatttgcaataggacgtaaatgacggttgcgaccagcagcgaaccgacaaccgcaatcggaatcgatttgccgggattttttgcttctccggccatgttaatcgggctttgaaacccgttaaacgcaaatacgatacctgatgtggccaccgccgtcagcacgctcgcccagccgttcggcgcaatgcttgaaccggatgtgaagtttccgccgtgaaaaccggtaaacagcagcgctccgattgtcagccccggaataataattttaaagatggtaatcaatgaattcgcttttgaaaacaagttaactgtccaataattcagtaaaaagtaaataatcagcaatacggatgcgaagccgagccctctcccgtaagtgtgccgttgtgaacgagattgcttgtccactttgcccagtcccacggccatgagctcatatattgaacagacgcaaccgcctccaccggaataacggaaacaatcgcaatccagtttgcccatcctgcgataaatccaataaatgatccatgagaatattgagtatattttaccattcccccggcttccgggaacattgaacccagttcactgtaagaaagtgcgataaacaaaattacgatcataccgataatccaggaaataattgcggcaggtcccgcaatctgagccgcccgccacgccccgaataaccaaccggagccaatcatcgacccaagtccgaccatcatgagtgcaaacgttcccattctgcgatgtaattgattcataaagttaacacctttcaattaaaatatgactccagcgctatcatatatttataatattattctgaaaatagttttgtcaatctttatcgcattaaagcggcaagccaaaattaaccttccgatgtttaaacagccgttaagcgggaataactactgcaagccataaatagaaaggagtttttatcgtgaaacaaaaactgctcatttcaggacttgccgtgtcgactgtcggagtgacttcctacctgctcaaagataaatcaaaccgccaaaaggtgatgaactttatccgcaatatgaaaacatcgctctccgggaagcaggatattgaatcattccccgtcaacaaagcaggcaacccgcatcccgaagatattgaagataacaaaatggtatccgaaggctccatgtacccggttcaatattatgatgacaagaagaaataatctgtgcccgggctgcccggccgtatcaaacggcggcagctttttttatgcagacggcgttttatagatccgccaatattggcgcgatcctttctcccgcacggtaatgcccagtttggatatttccgctttcagctctttcgcatcagccttttcctcctctttcagcgccttttctctcgcttttaaaagagcatttgccccgggctccaaatccggcgtgtccggcacccaccgtttgtattcttctttaaaaggatcttccgtccccagccagacatacccatgcgcgcgaaacgcatcagccgctttttcaaccgccggctcaagcttctcccgaaaaagctcctgtccttcagtgcctaataaaacaagatacttcccatccgtaaacacaccggaaatgctgtctttcgaaaacacgctttcttcattatatatggttaaggacaccccgctgtccgtcacgactgccacaagactttctttaaaagctgcccgcgtcagccacactcccccaattaagccgataacggcggttgcagccgcagccttccatccgtgaaaggaagcgattatttccagcggcccgtgaaaaggcagccaatccaatgttacggcccacttcgtaatgaccggcagaaaccatccgatgaccagccccaataatggcggcaccagataaaccaaagctttttcaaccgatgacaactcaagaaccgtctgtttttttatttcgttcatgtttctcctccgtctgtgtttttcacaactatccattatacaaagggttggatgattctgtaaactggttccgaaacaataaaaagcctcccggccgccgggaggctctttaaaatagaagctcatatacttcattcaattccatcgtgcgcttctcatcctgctcgttctcagcatatttgatttccttttcaagcacctgattcagcgcatccatttccagatcatttagatctttcacgaactcgccctcatttgcataatgcttcacctgaagctttttataaaccccccggcacacatcatgctccaagtggttcgaaagcgactcgcgcaaatatccgagtgtcctgtccatcatgtaagccctcccttttctttaggaatagcttcccggaaagagagaaaaactatacatgaaagcaccgggcggctgttttaactctgtacctgaatggagaaaaatccgctgcttaacggcgtgtacggcccgttcagccccgttgcggagaaagagaacgttcctgaactgacataagaaagaggaacgctgtaatatttaatatagcctgtaacgatattgccgtttttcgtatattcatcttccagcgcttttgacgtaagatttgtaatattcgttccgttgttaaacgcctggatcgtattattgttcggatacccttggaaatatacggctaaataacccgttgtccccttcatcggttttgatgcgctgatttggttcggaccgatattttcccattggtaattctgaccgtcagacgtcacaccgataatacggatttgtgttaaagcaggagccggcgccgcagacgctgacggaacccacaacccgctcacaagcaacaaagcagcggcggccgcggcaaatagcataacgagtctctttttcatgtttcttcctccttgtggttcaaatttataattatgttaaatattataagtttcattttatcagagaaatcaatagatagacagaatcaatcagtcaaattggtgaactttttatataaaaaagctatctcctaaaggagatagcttatataacattatttctttccacactccaaaattgtgtatttactcggagtctgaattacatttaatagtgttaatccggctttttcaatcaattgttcaaactcggttatctttctgactctgccgcctgcagagcatactaaaaataataaatcacgaaaagcttcttcaggggacagcctgtctgcttcaggcacattttcaactataatcagcttggaatgatcagacatggcaccggctatattttcaagaatagcaaccacatgctcatcatcccaatcgtttaacactttgcttatcacatacaagtctccgccggaaggaatttcctcaaacatactcccttccgtaaactgacagcgttcgctcatctctgaagatgctaaatgcttttttgcactttgtatcgtttttggaagatcaaacaatatcccctttgatttaggagccacacctaaaatgcctgttattaactggcccattcctcccgcgacgtctacgataacatcaaacttttcaaatgagtaagctttcaatatggatggcagactcatttttgaataaatctccatcgccttatccattgtttttaagtaatcttgatcaagactattattctcataccatttatcaccataaatggcttcaaaagcggatttgccggttttgatactataatccattttaaacatagactgcactactgtttcatgcagcagatattctaccaaaggctcaatggattttgctttcccaggcatcaaagtggcaccatactctgttacatcataatagccattttgagcttgggcgaccaaaccgacggattccagcgctcttaagagcctgaataaggcagaggggttcaattcaagggcttcagctatcgcttccgctgaagctggtccattttgaaaggcggaaaatacatccaattctaccgctgttttaactgccagggaaaaccccagccctgaaaccatttgcatgactgcggcctgaggatatttcttcggtacttgtttatcttgctgaactgaattggtcatttacgttaacctccgattaattaaatggtttctgctgcttttttgatataacgcatatactgattgagcagattttctacagtactcttatagtactgattttgattatattcaattccaatgctcaattttttctctcttaccaacacaataaacttaaacttgtaattccaaatttcatcttcacttatatcattcccggttgaaagcggagataccgtaaagctttctgtgtgcagttcattatcaaattcgcccatataattaaatgaaatgtctggttttgatttctcttttatatcttgttttaaatatcttaaaataccatatcctatcccttgatcaggaatattggctaaggtcgagttaacattatctaaactcgaaccgatatgatcagaatcggagacctccaaagccaccggatagattgcagaaaatctgcctactgttctgtagatattaagcttctcactctgatgagtgcggccatggttgcctaagtgcacgagagatgtattactgcctgtttgatgttttactgtcaaacctaaagctgtgagcaaaacagtctcaatagtgaaatgatcttgtccttgaatcgcattcattatattttcagtttcccgaacattaaactgcctgtacacttgtctgttatctttgactttggcaatttgcccctgaatatcaaccggaatagacggagcataaacattttcgattttcgtccaatactctttctcaaacaacagccgttcactttcagcatatttatagagataatcagaccattttaaatacgaatcggttttatttggtaatacaatgtcttcgttacttttaacttgctgatatgctgtattaaaatcttcaagcagtattctccaagacatatgatcaatgatcatttggtgaatgacgattaacagatgttccccatctgcttccttaatgagtgccaatttaacaagcgggccgtgagtcagatccatactggcttgtatttgatttattttcatttttaaaactgattgcggcatgtttattgcattgatcagatgaaagtcaaacaagtcgccgtccgtcaggcctctgattacctgtaccattctatcgcctttacgtttgaatactgttctcagactgtcatgatgctgaataatccgggtgaaaatgtcttttacaatatcttcgccaaacccggcttccctgtataacataaaagaaagattccgatggtgcagagtatcattatggctttcagccagccagcattgaattggcacaagacgggcttctcccgttatcacactgttatcagatgccgctgttatataactgactttattcgaaactccttcgattgtctggtaatgaaagatgtctttcacttccagcctaagattgaatttttccattctgaccgctgcttgtatggctttaattgaatctccgcctaaaacgaaaaagttatcttttatactgattttagaaacttcaagaatgtcggaccaaacctcactgacgattcgttcaatctcgtttctcggagcaataaagtgatgcagctcggcattattttcagctggaagcggcaaacgttttacatcagtcttcccattgttcgtcaacggaattttatctatgccaataatgactgtcgggatcatatattccggcagatattccaataagtattcttttagctgagaaggcggctgcgtatctttacatactgtataggcatatatctgatcattgtgagcaatcgcaaccgcttcttgaacattgcggtgagacagcagtctgtttataatctcatccagttcaattctaaatcctctgatttttacttgtcggtcgattcttccggcaaattctatattcccatcctcattccacttgcctaaatctccggttttatacattttctcaccagaatgaacaagatccgggataaatttagccttggttagttcttcacgattgcaatagcctcgtccaactccttcccctccgatgtataactctccgataactcccggcggcacaggcttctgctgtttatctagtatgtagatagaacagttttttatcggtgtgccgatagggattctctttatattggaaatattatcctggtttatcgtataagctgcagcatcaacacagcattccgtcggtccatatacatttgttatataaggacggtcattctttttaaatactttatagaaacgctttacttcttcaggtttaagcacttcgccgcctataataaaatgttttacacctatacggccacactgcggagactcagagagcaggctgagataggctggtgttccatcagaaatagttattttattttggatatagaattcagcaagtttcgtgatatcatgcctggcttcttcagagacgatgtaaagagagtgtcctaaaagcagtgcagaaaaaatctgtttgacagaagcgtcaaaagaaaagggtgccaacaacgctacattctgctgcccgccatgtttgcagtagatacgttcatgcagggcttctgttaaattcgctatacttttatgttcgatcatcacaccttttgggtgtcccgttgatccagaagtgtagatgatataggcaaggctatgcccttccgttcctcctttaacattcctcccgtcgtctggaactgtttccaattcattcagacaaacactttctactccgtacctttgaccatgattgttgcgatccgtcagtaacaaacgggccccgctgtctttgagcatatactcaactctttcttgcggatatgatggatcaattggcagataagctgctcctgcttttaaaattcccattattccgatgataaaatcagtggttcggtctgcagctatgcctactgcttcattctttttgacacctttttgaatgagtgctcttccaagccggtttgcatttttgttcagctcactataagttaagcttccgtcttgtgcagacacagctatttgattcggcgttgcttccgcctgcttctcaaaaagctcacagatagatgcatctgtgcctctgcttctcagtgatcttccactgtaactcaatatttcgcgtcgttcattttcttctaaaatgttaatctccccgattagtccatcttgactttcaacaatatgattgaggatcattaagaatcgctgtgagaatttttctacagttgtgcgcttaaacaagtttgatgaataagtgaactcaaacttgatatcctcttttgaaggaaatgcttgaagcagaagatcaaatttggctgttttgttttcataaagatacggcttatatttcagcccatttacttcaattgccggattatccatcagctgaaggacaaacataacgttgaaaagagcattctggtttatatccctctcaaggttcaaatggtctacaagctcttcaaaaggataatcttgattttcataagctagaagcgcattatccctaacggcttcaagcagttctttgaatgttttgtcggcagatggtttatttctcagtgccagcgtatttacaaacattcctatcatgttttctaattctttatgctttcttccggctacaggtgtgccgataataatatcttcttgaccagtaagtttatggagaagcacattaaatgaagccattaaagtcatgaaaagggtgactttttgttttgcgtttaattctgttaacttggcagtcagctctcttcctgcataaaaatagattcgttcaccttgatcatctcgttcggcttctcttgaaaaatctgcgggcagattgagaacgggaatttctcctttaaactcatttaaccaaaaatctttttgttttttcatttcttcagtatgaaataattcattttgccatatcgcaaaatccttaaattgaatgttcaatgacggcagttcgttgccttcgtataaatttatcaattccctttggaagatcgggatagacgccccatccgctataatatgctgtaaatctatcattaaaagatgtttttgatgactaatctcggctaatcctgcacgcagtaaaggagccttttctacatcaaacgggcggacaaaattagacataaggctctctaattcttcttcggaggtcttgattctatccattttaaatcggacgtctttttctatgatttgcacaagctgcccgtcccttaaacctatggacgttcttaaaacctcatgcctgattattaattttttaaacgcatcttctaaacgtttatcgtccaactctccttcaatcattaaaaagaacgggatattataagaagtgctgtttttatttaattgatctagaataaaaattcttttctgtgcagatgaggcctcataccactctaaatcgcctgctttgggaatcacattcacatcatttgtcttcctcagagaatattcatccaaataagctgagaagagttttatattcgaatgctttagcaagtctgaaactgaaagctccgttccttgctgtttattgataaagttgatgatttctattgctatgattgaatctccgcccatttcataaaaatcggatgtaacatcgatcggattgattccaagggcatttccccaaatttgtcctgccattagctctgtttctgaataacagccgtcttccctgccactcagtcttattatttgaggcttgttgactgaagggttatctggtgcattgcttatcggtaatttttcaggcagtttcacccaatgtctctcccgcaaaaatgcgtaacccggcaagctgatttttcttcttttttctccttcatataacatttcccaatcgatctctgcacctttttcatagagcttgcttatatcaatcagaagactctcatctgttctcccgcctgcattataagccttaagtttttttccagcagcggtacttagatctctatcggtcttataagaaaatgcagcttcttcttgctgaaccggcgcttcgagcagactttcaagtttttccttcagatcttcgatgtcttttacgagaaaacacactctattctccagatgttttcttcccgtattcgctgtataacaaagatcagagagattcaaattgttttcttccgagataaaatgaagatactttgatgctatatcattcaggacggacttattttttgcagacagagtgaatacctcttttacctgtctctgttcagtctcacctattatttcaggtgcttcttccaatacaatatgacagttggttccgctgaagccaaacgaacttacaccggctcttcttggcgtctctcctttttcccaatttcttatcatgtcattcacataaacaggtgaattcgaaaaattaattaaaggattcggttcattaaagttgatacttggggggatgaccttctcttttaaagccatgcatgctttaatgagagacgccatgcctgatgccccgactgtatggccgatattgggtttgactgaacctataccgcaaaactgctttttatcggtatatttcttaaacgcattcgttatccctttgatctcaatggggtctcccaaaatcgtgcctgttccatgtgtttcaatataagaaatagtttccggactaatattcgcattcttccaggcacgtgaaatcaatttctcttgtgattcagcattaggagcagtgattccgttagaagccccgtcattattcgtagcgctccctttaatgacagcatatatgtggtctctgtcttctatagccctatgtaaaggttttaatacaatagcagaaatcccctcaccccatgcggtcccctttgcatttttatcaaaaatgctgattttagcgttttccgcttctatttcgctcatcgtacctatattttcaggtctcagaaataaattaacgcctcccgcaatagccatgctgcattcttcatttttaagtgcctcacaagcaagatgaaccgaaacgagtccggaagagcaggctgtatcaacaaccaagcttggccctttcagattaaaaatgtaggaggtcctgcttgccaatatgccgggataagtacctgtcattgcaatcatatccgcatcctttactagggaagcataggaaaacttcaagtcaccgctatgatcatgtccaacgaaaatacctgtattcgaaccttgtaacttgttccccgcataaccggagtcctcaatagcgtgataaactgtctccaaaaacaatctttgtttcggatccataagcatggcttctcttggcgaaattctgaaaaatgatgaatcaaacttatcaatttcatctaagaatcccgctctaaaataagaattctcattcgcactgggcagcaatggatcaatatctttccgccgcttctccggtaagtcccggatgcatgaggcacggttcataatgttttgccagtattcttttgcattattggcttttgagaaacggcaggatatgccgataatggcaatatcaaattgatttttcttggacttatcagataatccttttaaaatgcgcaaagccatttccctgtccattttttgctcttttacttgctccaatacatattgttttataatcgaaatatcatccacgattaatcacccctatcgattttgattctatataaaatatgagaagcatcatggatatatagaatagctgcttcaattgaagcagcttattgaattagttaatttttgtctcaaaaacctttccatcttctttacataacacctgcaccagatttctggcctgtaagacaacactcggaagacctcctcccacttgactccaatgcccaaccatataaaagtctttaagtccgggaagtgaacgtttcagttttttctcgtgcatgatgccttccatctgtttttcccagccctgccagcttccatttctattatttgtgtatcttctgatcgtatatggggtggatacatcagtcacgtcaatatttgatttaatttcaccaaaccatttgtctaattcatcaatcattacattcgcaattgcttttttctcttcttcatatttttcgcggttgtttttttgcaaagtctcccagtattcagcagaagttttcgcatacacgataatactcgttttgccatcaggcgcgaatgaaggattttcgttatatattttcacaaatatgtttttaacgttgtcacagccataggcgttaagaggctgttctaattccagactcaaataatgaggatatttttcaaacgtttttgatacgcccaatccgacataaatttgcggtgcacttgttttaaggttgtcataacaaaatgtcagttcatcatctgtatattttccatccagcatttcaaaaatagttttatagccatccgctgctgaaatgacgatatctccataatgacactgtccgtttttcagctctattccgatcgctttatcattttctactaaaaccttagaaacaggtgatttatattgaatctcaccgcctaattcaacatatctggcttcaataatttttgcgaattgcagagaaccttctacaggatgtcctgaagatttgctattagcccagcctaaagtagccataaagtaagatataggggtatctacattaaaccaaaacagacgatttacattttctcttacaaaactgcttttaaagcgctgggcgaattctttgatcgtcacttttccccattgccccattactttcatgtaagggccagcctttgctttgaaggcctcaaagtctgctaaatcgaacagttcgggcgctttatccaaatccagctctacatcagaaacaactcgaatgccatcagttaaaagcttaattgtttccgcatcttcaggtgcaactcttaaaaactcctgttctaatttatctacatcagcatacagcgtaaatgtatcaccatttctaaagttaacaaccgcaaattcttcatcattaatgaattccatattttgtattacattcagttctttccaaaatttatggaaggtattgttaggtcctgaaccgaccagccagctgatacaaccgtcaaaaaagtacccttttctcttccagccggtacataaaccacccggcagcaagcccatttcaaaaattttcgtgctgtatccgttcatttgcaagtaacagcccgcggccattcctgcaataccgcctccgattatgattgcagtcttgttttcttctgtattcttcattaattttccccttttccgaaactagttttctagaattttcaatccttcttgtatattgattttgccgttctccaggtcgtcaaatagattgttgagttcttgctcaagccgattttcagcagtatcttcttccgtttcttgctgatgatctttattcagctgcttgtcaatatactctgatagctccactacagaggaatatgtaaatatatcggatatatccacaatgtcaggatattgttgatttatcagttttaacagttgggttgccataatagaatcgccgcccatggcactaaagctttcatataaatccagctcttgcatatccaaaaccatagagtacatttgcgcaatacttttttcggtatcagagtaaagttctccctttcctttcagcactatatcttcagtatctgttcttcgacgtttttctgcttcgttttttgtcctgtttttatctattaatttgtttttgatttgctcagataattcaaaagacaattcatccttcgcaaaagcgaggagcttcatatttaatgtacctggaatgatattagtaagcttattcgatgctatttcttctaaaacggaaatagccctttctaccgtcaataatctgaaaatagagctctcatcagtaattccataatcgacagctatgccgacctcatcccaagccggccagttaattgacagcgtgtttttcccctgtttgttttgcatataagcaaaggaatctaaataagcatttgcagctgtataatctccctgtccggcacctccgaaaatagaattaattgaggagaacaaaatcgtgaaatctaaatctacgtctctcgttaaatgattgataacccatgttccattaattttaggagcgagcacttctttaaaaatattagcttcttttctaaagaggaaaccgtccccggcaactccggcacaatggaaaacgccattgatcgtaccgtatttctgttttatttcttcaattaccggctccatgctgtttaagtcagaaacttcacagctgtagcaatcaactttagaacccattgactcgatagctctgatggacttcagttttctgcaaagctttaaatccgttccatcagcaatgatatcgtcccatcggctttgatcaggcagtttagagcgattgagcaatacagcattgacgttatgttttccagccaggtgctttgcgatctccaaaccgattccgccggtgccgccggtaatcatatagacaccgttttctttaatctccataccgccgtgtttcttatcctttatcggttcaaccgtatccaaccgactgatataccgcttaccatccctaaaggcgacttgatagtgtttcccttttgttcttaactcctcactaataatttccggtgaagtatgttcatcaatatcaattgctttacatgaaacattttggaactcctgcgaaataacacgtcccagaccaaacaacgcggcgcccaatggattgattgtattttcttctccggacacttctgtcacaagatcagaaataagatgcaaattaatattgcttttcatcttattcttacttaatccccggactaagcggaacaggctgtatacgcctttattctgcatgtcttctaaatctgttaatgattccgttccttggcggctgatagaagacatatgtataatgctgctgatattttgatcgtttatgctatgcaataattgaacatagtcttcttctgatccgctaattaggaatttccgcccatttatcttctgaaattcatccccaaactccacttcaataacatcatcgtcatgaattttcaactgttccagtatagatttataaatttccatgttgtctttaaataacagtataggacctgttacctctgttttttcttcttcaaaagcttcttgcgccatccattttaattgataaagtgattcagaactttcttcaaaaagggcattaatccgatttactttttttaatacataatcggtgatttctgcaaaaacatttccttctgtatctattaactgaatatcacacagctttgtctctttactgcttgcgttctttttgacaaatgcataaaaatgctgcggcattcttgagtaaatcttcacgcttttatatgaaaaaggaaggaatgtactatcgtcatcatcttctccaataaacacgttcactgcattatctagcaaagcgggatgtaaaaagacgtcttttaaatctgctgtaaattcatcagccaattttaattcggccaattgttcatcagggcccagtatgacttctttgaagttcagccacctcggtccgaaagtaaagactttgctgattaaaccatttttattttcataattgacttttatcttctctctattactgtcattcctaacagagtctaaatcaaacattgatacagagtctgttaatggaaacgcttttccttctgcatgtgtaatccaggtttctccttcctgactggctattataaattgaatacattctttctttttcttaatgattgtgtgtacaatcttattctcatcctcatttactgttaacggagtgaagaagataatatctcgtaattctaattgattgcttttatagtaagcggcacttgctcttcttcccatttcgatataagtcgttcccggaataacgcaagcccccatgattttatggtcacttaaaacccaatccttattcacattaaatgtcgttgaatagatcgtctcattcattgaatcagccaaacactggtcaatcagcgggtgactgatatttttctgatgcggcgcttgacctcttctgtcttttacttctccccagcataatgttctttcaaattggtatgtcggaagactgacaatctttctgcgctcatccttgtacatttttgtccattctacttttgctcctctgacatacaggttgcaaatttccgtaaggtttagcagtaaatattcatccccttcagtaagaatgtcatgtatcaaattgtcagattgagcattcattttgcgatgttcagataaggaaatttctccttcatccataatctgttttctatcagaaccaactttatggaaagaaaaatatacgcctttttctgatatttcattcaggttatgccctgcaagcctgccgatttttctctttaattcttcgtaactttttacaatcagagccaatcggtagccgtaatggccccgccctgtgtttgctgtatagcaaatatgttttacgtttttttgagttccttttttaaagaattcattatattccttgatgagtttcattaaagaattctctgttttagctgataaagtaaatatctcaaatgtttcatttgcaggaatgacctcttcaacctcatctccagcatcttcaatcactacatgtgaattggtccccacaaagccgaaagaactgattcccgctctcctcggtgagttatttttaggccattcatgggctttgtctgtaacaaatacaggtgacttcacaaagttaatcaatgaattcggttctttaaaattaatactcggagggatgacttgatgcttcatagacagaacgatcttgataagtgacgccaaacccgaaacggcaacggtatggccaatattagatttaacagatccgatcccgcaaaactgcagcttgtccgtatattttgaaaacgcattggaaatcccctttatttcaattggatctccaagctttgtgcctgtaccgtgcgcttcgatatattgaatggtttcgggatcaatttgagcattttcccatgcctgaaccagtacttcttcctgggcgatggcatttggagctgtcaatccatttgaggccccgtcattattaactgcactccctttgataacagcataaatatgatctccgtcctgcttggctttacttaaaggttttaagatgactgcagctactccgtcactgaaaaatgtcccgtctgcgtctttatcaaatgagtgtactttatcacttactgattccatcattgattttttggacgttttgaagcgcggaaagaatcctaatgaaattccgctgacaatagacatatcgcattctttatttttcaaagcattacaggcaagatgcacaccaagcagccccgagctgcaagcagaatccaaaaccatagaacttccttttaaatttaataaataattaatccgccccgccatcaaacccggccagttgcccgtcatacttgtcgattctgattctgtaatgtagcggtacaacgtattattgacatggtcttttccaacaaagagcgatgtgttgcttccataaattttgtcccctgcataccctgcatcttcaatcgcagtccataccgtctccagcaatactctgtgagacgggtcaatggcctttgcttctttaggagaaatattaaaaaattcaggatcgaacttgtctacgtcttctaaatatccgccaggtttccagttatctgcttgttcttccgtcagatatcctgaaccgagaaaatcagtaaaccctttattgtttacgatcggtttaatgtaattgatcatatcttttggatattccgctttgcagtcttctccattcatcagattctgccagtattcatctgtattgtttgctttcggcagtctgcaggaaattccaatgatagcaatatcttcattgctgcttgcagcctttaattcttttagcattcgctttgcttctttctggcttagcttatgctgtttcacttgttcaaatatataagattgaacgctattcattacggatcactcccgctttctttctaagaaaatttttgataggaagggtaataagatctacatttttaccttaaaatggaattcagttcccgtaataatgtgataggataggcaggctgctttttcttcattcaattcgcagcctgccaatatccattttgcgaatatattcttacaggcccaattcagttattttcggtctggatgaaatatttgatttgcttcgctgacttccatctctccggatgccagcttattcaaaattgcatccaggtcatcttcattgtcttcttcagggattcggtcagaagacttctgatcactgaagtgggattcaaggtaggttgacatctccttaatggagggatacgtaaaaatatcagaaacatcaatgagagaaggccattctttctctatttcttttaccagatatatcgcggatattgaatctccgcccaaatcataaaatttatcagttatactgatttgttctaagcctaaaacttttatccaagctttcattagtttattttcaatatcgctgaagctaaatgtctgatcggttttcgactcaacagatttttttacaatcgcctgctccttaaaagtcaaaatatccggagataatcggaaatgaatttgatcttgatttaattccagtacccgatgatcaatttccccgatgatcacattccggatgtccttttgcatgacttcatcgaaggcacgtatcgcttcagctgaggtaatcgtcttaaagccgttttcatctttatgttcgtttccggccttttgacgctcttcaatatattcggcaagcatgcccacatccgaccagccgcaccaattaatcgtaactgttttttcatccggtcttcttcgctgtctgcgttctgcaaaggaatccaggtaggcattagccgcagtataatcagcctgccccatactccccgcaagtgctgtgatagaagaaaacattatgaagaaatccagatgctcatgctttgtcagctcgtttaatatccatgttccattaactttcggtctgagcacgttatcaaacacttttttttcctttctgaaaataaacccatctccagaaacaccagcactatgtatgacaccgtggattgtattgtatttactctttatttcctcgaatacatgaatcatttcactttcatttgcgacatccgccttatagtaatctaccttagaaccgctttcttttatttcttttagagcatcgattttcttgttgtttcccttctccatgttgatctgctgctcggagcgtccaatgaggattaattggacattttcttttgatgataaatacttggccatttctaatcccagtccgcccataccgccggtaataacatatacaccgttctttctgatgcttattttcccttcccgaattacggataagtcttcagtctggagctcttgaacgtatttatgccggtctctgtaagcgacaagctctgactgtttttttgagttgatttcaaacaagatgctttccgccataagattttgatccaaatctatgcatctgacacttacacgcgaatattccttttcaattacttttccaaaaccgaaaaatgccgcgttatgcgggttaatgtctggttcttcaccgcttacttgatgtgcaaggtctgcaaacagcatcagttctatgttattttttgtattttctacaagtgattttgttaaataaaataaactgtctacccctgaggatatttttttctgaagctgatatatgtttttgtctttctcattgctgatagacatcaaatggacaatctgagaaaccttttcactttgaagagcttttacaagacagtcataatcttcttgagaatcactgacagtataatgatggcttccgattttagagaaatagtcaccctgttccgcgacaatcacagttttcccttccagttctaaccttcgaatgatttcctcggataaactgcagccattattcttaaataataaaataggatgatgaatttctcgcatctcgtgtgattgatcgctttctcttatccaagatagcttatgatatatattgtttcttttagtcttttcagctgctttatgcaccctttttacgatgtaattgttgatttcaccgaaaacttctccagtgtcattcagcaggacgatgcgaaacgttcctgtttccccgttgcttcggctctttttcttgatataactgtaaaactttttagaagcagagccataaatcttaaattctttataaaaataagggagataggtttcgttatctattgtgaatgtcccggcattaacggcacaatccatcatcgcaggatgaagcgaaaactgaacgaaatcactctcatattctttcggcaattccaattcacatagaagcctgtcgtcgtctctgtagattgcgttggtgcatttccatctgcctccgacttgaacgatgctttccggtctattggtatcttctatatgataaaccgacttgtattcatcggtgtttatttccgtcaatggatgattattacgttgaatgacataaacagaattaaagcttttctttaaatcctcaatgtcatatgtttcccgtaccggttcttctttcgcaatgaccgcttccgcgtgttttatccatttatcgccggtcttacttatcacactaaactctaaaacgctgtcctttttctttatgatcgtatgaacttctttaacttcatttgcttttacctttaactgatttgaaaacgtaacgtcttttaacagaatgccgacaggttcgccgaagtattttcttcccgcttctctagctgtttctatataaaccgttccagggataacgtaagaatcattcactttatgttcatttaaaaaccaataatcagtgacattcaaatgggatatatacacttccagattcagtgactgcactgcaagattgctcaataaagattgttttttctcatcggctgaagggccgtctgcagccagctcagcccataatctttttccgctgaatttgtatgtcggcaagctgaccttttgaaaattcatctcgctataaagatcttcaaagttaatattcgccccatcacaatacatttcacataaaatatgtaagtcagaggttggaatattagagacgtcttgtctgactctttgaatcacattttttattgtttgagtattctgcacactgtctgtatgcgtttttcctataaactttgtttgatttgttatcgattgaaagtatatatttttctcccgatacgttttccattcagagcatgataaaaactccagcttttccagcagttccgcgacagagcttattaccatagcgagtctgtatttgtttggcaatctcccagtgtttgctgtataacatatatctcccagattcacatctgtttctctctttaaataatcaatatgatctgtaagcaagtgcgcgagagatgttttagtcctagctgatacagtaaaaatatgttcagataaaacggattgatcgactttttcaactgcgggtgcctcttctaaaatgacatgacagtttgtaccgctcagcccaaaactgctgatgccgcacctgtatactccgctgctctcccatgctgaaacggagtcattgacgtaaacaggcgattcatgaaaattgatatttcggttcggcactttaaaatgtaaacttggcggaatttttttatgctttaatgccattaccgctttaattaaacccgctattcccgccaaactatcaagatgcccgatgtttgttttgactgaagatactgcacagaactgttttcggtctgtatattttctgaaagcccgttgtaacgcatttatttcaatcggatcccctaatttggtccctgtcccatgagcttcaatatatgtaattgttttaggatctatttttgcatttttccacgcatctactattacttgttcttgagctgctgcgttaggagcggtaattcctactgagctgccgtcctgattaacagcgctccccttaatgactgcatagatctggtcatgatcacgaatcgcttgggccagcggcttcagcaatacggcagcgactccttcgccgctattcgtgccgtcagcagaatcatcgaaagtccttacagcaaaatcagatgaagaattcccgatatttaacctgctctcctctattgtctttgggaatacttttatattcactccgccggctaatgccatatcgcaatccttatttcttattgcctgacaagccgtatggagggcgacaagcgatgaagagcatgcagtatcgattaccattgctggccctttaaaatccaagatatatgacagtctgcttgcgataactgatttaatgttacccgcggtagccagtccgagtaatgattgatctcctttttcaagcaatctgaagtattcatttgagccgtcactgctgagtccaatgtatactcccgtatttgtcccacataattttccgccgccgtaacccccgtcttccaatgcgttccaggccgtttcaataaataatctttgtctgggatcaatcaactttgcttcatttggaaggatactgaaaaagtcacaatcaaatttatcaatctcatccatataggctatttttgtataggctgcatctttactgtacttggttccgctgttttttaatgactggtcagcatctttttttctgttcagaggaatgtctctgatgaactcttttccttgtaaaagtaaatcccaatattcatttacgtgattggcttcgccgattctgcatgataaaccgacaatggcaatgtcatctccggaaatgtctttggtcccttcctcgtttttttgtttctttacattaggagtttgatttgtaaaagcggccgcttttaagttacttaaacttataaagtctgttttcatttttttacctcgctgagaatcactagataggtgatcatacctgtcaaacttcaaagtcttcaaagtgtttttttgtgtttgtttcagaaaataattgattaaatctttttttctgttcatttataggggttttttttgttcgaaacactgacttcagcatttctactgccatatgcatttgttctcttgacggctgacgacctgatgtttcaagttcagcctgtatggcagctactttttcatatggttcgattacacctttggcgtattcctcattgttccagttgtaatttttagtagcaaccgcgatccctaaacttctcgagataatagaaaaaccggcttgcagtgaaacagattcgttcaaaagagtctcttttataatcttcacgtcctcttctttgtcgtagctgtacgatttgatgtcagcgatattgtttcttacaagattccttaatacagatttcggcccaaattcaatcacagtatcagtatgatttgcttctaaatacttcatgattcccatccaatttaccggttttacgatttgagttcccagtatgtcagccatttgctgtttatctgaatatggaagagccgtcacattagataaaactttgtattttggagttctgagatcatacttttttaactcatggctgaatttttccgcagcaaaacccatgatcggagaatgaaaagcagcacttacatttaatttaaaaatgtctgctcctctggctttaagagtttcactaagctcttcaactgctgccgcttctccggataccacaacatctttatatccattgtagttagaaacagcaatcgtttttcctcttgaagagagagattcgcactcttcttctgctattctttcatccaggttcctgataacagccattgctccggtcccttgttcggcagcttctttcattaataatcctctggctctcaccagctttacagcgtcctggaaatccaaaacgtcactgcaaaccaaggcagaatattctcctaaactatggccggcgatatattcaggttcttttccgacctcttccatgtagattctgaattgtgcaatacttgttgccaggatggccggctgagtattttctgtttgagatagctcagcggcacttccatctatacataatttcttcaggtcaaatcccaatgcatcactggcttcgtcatacgtttttttagcgataataaaattgtcacataaacgtttgcccattcctgcatattgagatccttgtcctgaaaataaaaaacctattttcgacatttaaatacctccaaagtccctataatgcctgatttgccttacattctgccgatcagcaaaatgtaaggcagaaccggccgctttatattgaattgtctgctttgtctgctgtaatcacttgaatcaaattcatgtagttataaaataaatctttcattttgtgctcatttagtttctgatggttatatataaaaacgatttctgcttcggatggcttttcatgaactgcaaaaaccagatcatataattctgagtactctttttttgattcattactaatataaaaaagaggaaaaacatcttgggccgaacttgatttcttatagtgagtattcaaatcgtattgtgaatcctcttgattctcaatctgctccttcgccatacgaataatatcgtgaaaattctcgatatcagacagatcaaaagacagctgactcatccgatcatctccatgacccgaaaattggatatgaaccaagttttgctggctgacatcagctaataaaaatacataacccgctaataaaacatgagaaatatcatatttgtaggtattgcatattgtttttaaaccatcataataattcgcatttaccgcatattcgtgcatggctgtatgactttgtccagttgattccgagatgtattcaagcggtaaagtaataggaatgatttctttttccaaggacactgctatctccgcaaaggctatagctgattctatatattcggacaatctgtaaatagtcggatatgcaaacaagtcagcaatttgaatttgttttggatacagcttctgaagctcattataaactgcaacgattttgattgaattaccgcctgcttcaaagaagttatcatgtattccaggctcttctatttttaaaacatcggtccaaacacggctgatacttttttgtacatccgttaccgcttcctcaaaaggccggtcaaaacctgttctatctataacaggttcaggcagtgccaggacatttatttttccgtttgctgtcagcggaatttggtcaattttcataaagatctgcggaatcatatactcaggaagcacaggtgataataacttaataaattctgaaggatatacagtgctttctgccacataatacagaactaaatcttggactcctgcggaatttgtttttccggcagctacacattccttaactttttcatgttggtttactatgctttcaatctctcccaattctatccgataccctctgatctttacctgattgtccattcttccgataacgtccagttcaccatttggcagccaccttgctaaatctcctgtcttatacatcttggttcctttaacaaacggattgtctacaaacttttgcgcagtcaaatcttcttttcctaaatatcctctggccattccggctccagcaatgcataattcgccagtactgccgagcggtacagtgtttccatcatgatctactatatatatctgtgtattcgcaatcggcttgcctatatttacactattttcattggttaagtctttcacagaagaccaaatcgtcgtctcagtcggaccgtacatattatagatcttcagatttttatatttttttagctcaaataacaattcccgttgaaatacctcgcccccaaccatgatggtcttcaatttctgaagactctccgtactgttttctgcacttagcatcagctttaatctggatggcgtaagctgaatagtattgacatcagtctcaacaacgatcttgtttaacaagtacggatctctttgttccgcttcaccggctatgacaactttcagcccttgagttaaaggcagcagcgactctaatccgaatatgtcaaatgagcacgtggtgaccgaaagaaggacattgtcttgtgaaaagctgatcctgtctgttattcccttaataaagttatgaacggcacggtgctctacggcgacccctttcggttttccggttgatcccgacgtataaatgacatatgctaaatcttcggccctgttaataacatcaatgttcgtctccaactgatgtaataaatcctctgaatctatgttaaatatggttccgctgtacgttaattcatttggaagtccttcttcagttaacagcaggccgcttttactgtctttcagcatataattgatcctgtctgccggataatcaggatcaagcggtaagtagcatccccctgcctttagtattcctaatattcctataatcaatcggaaagaccttcttaccaaaataggaaccacaacattctctttgatgccgttttccctgagggctcttgccaattgatttgccttattattcagctccttataggtcaagaagtctccgttccattccagagcgattgcatcaggtgtccttaaagcttgctcttcgaagagctcttgtaacgtcttttctttcttatatgataattccgtgcagttgaattctttcaccagcttttgtttctctgtctcatttaccatatcgatctgagaaactattacttcatgatcagccgctgcctgctgtaagatgctaaccaggttatctaagattgaacttaccgtttctttactgtaaacactggcgttatatgtgattttcatatgcaagtcgtcaccgggagcaattaaaagctctaaatcatagttggtttgttcaaacccatgttcagcagttatttttacactcgaacgggctgaatcttggaaaagatcctcactcaacgggtaattttcatacacgactacgtgattgattaatttattcttcatacttgtcaaagactgtatgtctgccagagaacaataactgtattcgttcgcttcaataaagtctttatttatttgtttagccaatgaaataaatgatgtatcacattctcttttcactctgattggcactgcatttataaataagccgaccatattttcaattccgtttatctcactcggtctgcctgaaacaatggaaccaaataccacatcatttgtattgttatatttctgaagcaatatcccccatgctgtttgaacgatagaatttaatgtaatgctgtttgactcagcgatttttttcagcttagcggcggtttcaccgttaagcgctcccagtttttgatcatgctgatactcgtcagatttcaattccagttccggaaatgagatctcttgttcatatgcagaaagatattccttccaatattcaaatgcacggtccttgtcctgctgatcaagccattcaagataacgactgtacggtacaggtgattcttgaaggagttttttcccttcagccacgtcaccatatagatccataagctcttttaacaggataccgacactccagccatccaaaataatgtggtggaaactgtatatgactttaaatttatttcttcccagcttgatcaccgatactctgatcagacaatctttgttcagatcaaacggagtattcctgtctctcaccttgaattgccctacaaaggcatccttcttctgctcctcccattggctgatatcatgatattgaatgtttagttttctttcttttaaaatggcttgtttaaatacacggaaaccgttatagaaaaatgacgttcttaatatttcatatttagcaatcagcctgtttaatgcgtcactgagaacttctgtattcagatttccttcaactgttatttcactttgttcgaaataagcgctagattgatggtcaatcacagcgttatacagcatgccttcctgcatcggtgaaagagaatgaattttttctacttcagcaccgcttgcaagaatttgatttagctcctctatttgaagatcgggatccccataatcccatggagttttctcagatattttcttattcacacaatgttctatgatctgatttattttcaattgataggctttcgtaaattgctcaatcgtctctcgtttatattggtttgcactgtaattgaacgtaaacatcagcctgccatccatgatatatccatttatttctatactatgtgtctttttatttcttccagatatgctcgttccggcggacaaaggtgatatttgaaataggttgctgcgatcttcttggccaaattcacccaagtagttaaaactgatatcaggttttaattgaagatgaaccgagtccgacaaatatctgagtattccgtaaccaatcccgttatgggggatatgtctaagcatttcctttgtatacttaatggagcttgataaactattactttccgtcatatcgagaacaattgggtatattgtcgtaaaccaacctattgtgcgatggaccggggtttttataacactttcacggccgtgcccttcaagattcacaaggatcttctcgttgccggtccattctttggctgcaagtcccagtgagcaaagcaatatatcattaatttgtgtatgatatgctgcatttgtatttcttaaaagtgtttttgtttgatcctctgttaattcaattttaatttctttactatcttcataagagcagctttcggcaatgaaatcctttggaagaggttcaataatagccgtttctatggtctcccagtacccagcttccttttgaagagccttgctgtttgcatattctttcaattgacgcgcccattctttgaacgatgctgttttagtttccagctccaccttgttcccattaactgtttgaagataagctgtttcaaaatcttccaataggattctccaagatactccgtcaatgatcatatgatgaatggttaatagaagatgatctccgtttttggttttaaataccgccagttttattaaaatccccttttccaagctcaattcgttctgcatacggtcagccagtgattcaattgccatggctggatcttctgtttgtgtcatatcaaatacttctaaagtaaatgtttcttttgcctgtttaatgcccctattccattgcttaatttcaccgttttcctttttaaactgcatcctgagggcatcatgatgcctcaccagttccaaaaaggccgtttcgattgctttttcttctatgccggactttttgtaaagcataaaggcttggttatagtggttttcttgttcaaatctctgttctataaaccatttttgaatcggtgtcagatcaacgtctccttctacaatcgactgatctgcttgtatatcagctgattttacgtgagcactcaagtcttttatgtgcggatatttcattaaatctctgacttccagttttaagccgtatttttggagttcggaaactactaaaattgatttaattgagtctccgccgatctcgtaatagttatagttaatcccgattgatttcatccccagaactttctcccatacgcatgcgagaatttgttcctttttatttcgcggtgcttcatatgcagactccaatacatccgcaatatctataatcggcaatgatttcgtatctatttttccgtttgaacttaacggcattttttcaatctggaagatataacttggcaccatatataacggtaattctttagacagattttcttttaaagcataaacatctatttttttgtcggaagtaacataaccgcagagatatttatccccatgttggtcatctctcgctacaacaacagcctctcttatgtgactcattttcagaagccggttttctatttctcccgtttcaatacgatatcctctgattttgacttgatcatcaattcttcctaaataatcaattgtcccgtccggcatccattttgccatatcccctgttctgtataacttagccccgggttcaaaggggttatctacaaatttttctgacgttaagcccgctttatttttatatccgtctgcaagtccttctccgctgacacaaagttccccggctgcccctaaaggaagtaattccaattgttttcctaatatataaagcttagtattatccgcaggtttgcctattgatactgcattgccattgtctctttcaatatgatattgatgaatcatacacccgactgtagcctctgtcgggccgtattcattgtagattttgacatgaccgttaaatgcaccgtgtatcttttttgcaagcccggttttcagctcttccccgccgacgattattttttttatctttgacgtacttaaatctacattctccagcaatctcaaatgcgtcggcgttagcttaataatatccgctttattttcttctataattcttctgatcagaagagccttgtccggtccctcataaataataattttatttcctgaaataagcggtgtataaattgaagtaaccgttaagtcaaaagaaatagaagaatacagaggaaaatcaatatcttcatcatttacatatatcttatttgcccaatgaatataatttaccacgcctttatgttttaccatgacgcccttcggcagccctgtagtccctgaagtataaatcatgtaggcaaggtcttccgggcaactgacattcggcagattacttctgttatgcatatatagagtaggatcacttaatgataaaatttctttattgaatgtaataccacctgacaatccgttttgaattaggagaatgtttgcatcactgtctttcagcatgtaatttactctttcatcaggatattcaggatctatcggcaaatacgctccccctgctttcagcaccccgataattccgatgatcatctcaagagatctctctgtcatgattccgacaatgctgttttctctaattcctttttgtctcaaaagattagccaggctgtttgatttctcgtttagttctttataggttaatagcgtatcttcttggacagccgcaatacgttcaggtgttttttctgcctgctcttcaaataattgatgaatcgttttattccgaggaaattcagctgccgtgtcattgaatatatggagcaatgtgtgcttctcctgttcaggaatcaaatccagtttcattaaaggttgatctaggccggcagctgcactttgtaaaagcttcgtaaaatgggcacccattctctcggctgtttctttttcaaataattgactggagtattccaagtggaacttaattcctttatcaatttccgtcgcggttaacgttaaatcgaattttgaaatattgatctcggtttgaatatgctcttccggatttggatccaagtgattttcaataccgtaatctgcattttcaagtacaaacatgacatcaaacagcgggttccggctcgaatctctttttaccccgagtttttgaacaatattttcaaattggtaatctgtattctcaaaatcttttaacgtatgatgtttgacctcttctaaaaacgctctgaatgttttatgttcctcaggaaaatttcttatggcgacggtattgacgaacatccccaccgtattctccagttcggtgtctgaccttccggactctgccgttccgatgatcacatcctgctgaccgctgtattttgaaagcatgatattatataccgccagcagcaccatgtacaaagttgttcctgtttctttcgccaccgactttaagcttgatgttaacctttcatcggccgtaaagctgactcggcttccttcaaagcttttgactctcggccgctcgtaatcagtctgcagattgagaatcggcagatctccgcttaaccgcttaagccaatactcctcttgttcctttaacgcctcttttgttcctgagcttacttgccattctgaataatctttatattgcagcggcggctgttttagtttatgacccgcatacagcgcattgaattctttgcggattattccaaccgatacaccgtccgcagcgatatgatgaacatctaacagcagcagattccggtcttcatacgttatgagtccggctctgattaacggtgctttgtccaaatgaaagggtctgataaactgcttcacatatggtcgtatcccatcagacggcagcttctgataattaaattcgagctcccatgtatcgtgaataatctgaaccacatcgccgcttacaacatcgaaacttgtccgtaacgcttcgtgtctgccaataatctcttgtagaactgattcggcttttttcacatctaattttccgtttagttcaatcataatcggcaagttataaacgatactgtctttatccgtctcccaaagggcaaacattcttttctgagcagatgacgcttgataagaagactgctttctcgctttactgatgaccggataattctgtttatcccgcttttgaataagacggctcaactgtttgatggtaggctgctcaaaaagctccttcacctttatatccgtgccgaatgtttttctgatgcgggaaatagtgaacgcagctgttaaagaatgtccgcccagttcgaagaaatcttcatttatactgatccgtttatgcccaagcatttctttccaaatttcagctagtttttcttccgtttcatttgccggagcttcgtattgaggtactgacaaccgttgcaagtcaggaagaggcagctcttttcgattgatttttccgttagctgtaagaggcaactctttcagttgtattatgaaactcggaatcatatacttcggaagaacctgtgccaatttctcctgtacgaacgagccttccatctcaatgtccccagtaatatatgcagaaagatatttctcctctatataaacaaccgccgcttcttttataccttccagctgtaatagttggttttcgatctctccgatttcaactctaaaacccctaattttgatctggttgtcaatccggcctaaaaattctatatttccatccggcatccatctgccaaggtctcctgttttgtacatttttgctccacgatgaaaaggattatcaataaatttttcattcgttaattcttcattattgacatatcccgatgctaaacctaccccgctgatacaaatctcaccaggtgctcccacagggaccagttgatctgaacgatccacaatatagatattaataccgtgaattggtcttcctattctattgtatatttcacagttttgaatatgatctagatcaatgctatgtgcaatacagccaacagtgctttcggtcggcccgtaatggttaataaacttcatccatctgcatttttcagcgagctttttgacgttgccgatgtttatgctttcgccgcccagtataataacttttaaatcaggacaagacgccagcatgtcaacatcctccatcaatgttgaaaataaagtgggtgtcattttaagatatgtaatactatttttatgaatatattctattaatgatagagagtgaagatacacttctttatcaacaaagtggacttgtccgccaccggataaaactggaaatatactggtatagcataagtcaaaactatattttgacgtcactaacgacctgctgtcagaatttatgtttatttgatcacatacccataatgaataattaactaatgatttatttttcaccttcacccccttcggttttcccgaagtacccgaggtatatataacatatacctcgtcctcgagatcatactgaacatcagggtttgatgtattttggctggtataaatcgatttatccgtaatatccaaacattccgccgcaatgtttttatcagctaaaaagcacaaatctgtaatgaggatatcagctttgctatcttttaaaatatgatttatccgactgaccggtgattcatcatcaataggcagaaacgcacttccggtttttaaaattcccagcatcccaatcattgaatattctgaaggacggatcatcatagccgtaatgctgttttttcctgcccctttttccattaataatgttgcaacttgatttgccttttcgtttagctctttataagtgatatgctttcctgcatagacagccgctgtttggccaggtgtcttttccgctcgttcttcaaaaaggtcttgtatcgttttattcaccgtataattagaggactgcttattaaaatcctggagcattccgcgctcttcttcatttacagcgctgatgtctttcaggacacgcgtaggatcagttgccacttgctttaacacatgacagaaattaacacctatacgattaatgatatcttcacgataaacattattgttatacgtcatctctgctttgatttggctgcctggaataataaccagcccaaagtcatagttcgtctgttcaaacacttccatatctgtaatccttaaagcatcagttgtattatcgaccgccttgccatagtcatcaacaggataattttcataaaccaacatatggttgatcagtttctctttcatctttgtaagagcttgtatatccgctaaagaactgtaaccgtatgatgtattcgctttgataaagtcactgttcagcttttgggctaatgctataaataccgtatcaccatcgccttttactctcagaggaaccgcattgataaataaccccaccattttttctatgccttgcactctgcattgtcttccggaaataaccgcaccaaaaacaacatcatccacgttgttatacttctgcaaaagaactccccatgcagtctgaatcaatgcacttaaagtaatgtgatattgatcagctgcagctttcaacatcgaagtacatgtttcatcaataatgaatgttttcttcctattattgaaaccgccctcatcagcagaactttggaataccggcttgctgctcatattcatttagataatccccccaatattctaatgcggcacttttgtcctgattatccagccattctaagtaggtgctgtaaggctcggtatgctgaagcactgtctctcttccttcttttaatgacgtataaatagtttttatatcattcattattaaactcatacaccagccatccataataatatggtgaaaactgaacagcagtttatattctttctcatcagtttttaatacggttactcttattaagcaatcattcgtcaaatcgaatctcgttcccctgtctttaaactggacatttttaagccggactttcttttgatattccgagaaagtgctgatatcttcaaattcaattttaacttttctctctcttagaacagcctgtttaaacttacttaatccttcatgaaaaaagcatgttcttaaaatttcatacttctcgatcagcatattaaaagctgtatttaatctgccaatatcaagctgaccggataaagaaaatgtaagctgctcaaaataggcttgtgaaaacggatcaagcaatgcatgataaagcatcccgctctgcataggagtcagggagtggattttctctatctcttttccgcttgataaaatctgctccaaatctccgatggataaatccagatctccatagtcaaagggtgttttttcaggaatttttttcattccgcaatgctgaataatatcgattaaccggtttatataggattcggttaatgttttaattgtttcttctttaaactctttcgtactatagttaaattccaactgcagttgaccgtccataataaagctgttgatttcgatggcattcaattttttattagataaagaaacacttgtaccagatgatatatctgcatgctgaaaaacagcccgctttttttgagagatttctcccagatagttaaacccgatctcaggctttatcgtaaaactgatgtcttttttatgtgccggtgccgtcaagtatttaataattccgtaaccaatacctttatgaggtattcttcttaaatactctttcgtattttttatgcaataaggcagatcatcactgtgctccatatccagcacgatcggaaatagtgaggtgaaccagccgatggttctttctattgaaatattttctaatatgttctctcttccgtggccttccagaccgattaaaaccttgtcaagtcccgcccattcttttactgccattcccagtgaacaaagcaagatgtcattaatctgtgtgttataagctgcatttgtattcctctggagcttatcagttaactgctttgtaagactgacagtaatggtgcggctttccttaaatacactgtcagttttattgaaatctctcggaatttctttaatcttcgttttctcgatattctcccaataccgaagttcctttcttatctcacttccgtttgcatattccgccaatttacgtgtccattcttgaaaggatgccgtttttggcggaagaacggccggctctcctttttgcagattgttgtagacctgctccatatcttcaagcagaattctccaagagactccgtcaatcaccatatgatgtatagcaataagtagataatcgcccctcattgttcgaaataaaccaagtttcattaaaagtcctttttcaagatccattccgctttgtaactgatcggcaagtttttctattgtatttttgtaatccgtatcagcaagcagatcatatatgtccagagtaaaagtatcccgggcggcttggacatctctgacttcttgttttatttcgtcattttcggctgtatatatcaacctcaaagcatcatgatgctttactaataattcaaatgtctttgccagagcgtgttcattaattttttctttcacttgaaacatgaatgcctgattaaagtggtgaatgtccgcaaagtcattctctataaaccacttttgtatcggtgccagttcagttctcccgctaaccgggctctgatctgtttgagctttatataatttcacgtgtttactgaggttttttatttgcggatactgcaaaagatcttttacctctagactgagactgtatttttgaagctttgatacaatcagtatagattttattgagtctccgcccagctcatagtaattatcattaataccaatatcatcaattttcagaacttccgaccaaacatttaccagaatctgttcgacttcggaacggggtgcttcaaggtgctcctttatatgtttaggctcttctatttctgcaagtgctttcctgtcaattttcccatttggtgtgagaggcagctgttcaacctggatgatgacaccgggaatcatatattgcggcaaaatgtcacccaattgctccctcaaagctgctccggatattttatattctgcggttacaaatgcagaaaggtatttgtcaccgtgaaggtcgcacttatctataacaactgcttcttttatcccgcttattttcagaagctggctttctatttcatcagtttcaatccggaagcctctgattttgacttgattatcaattctccccaaaaattctatgtttccgtcaggaagccaccttgccaagtctcctgttcggtacattttagttccggactcaaatggatgatcaataaacttctcacgcgtcattttctctttattgagatatcctcttgctaagctgtcacccgacacacacaattctcccgctaaaccaataggcacaagattgttgttgtgatcaattatgaaggctttcagatttctgatcggcttaccgataggaatggtctttgccatcgccctctcagcttctgagtatctccacattgtagagcagattgtcgtttcagttggaccgtaggcattaatatagtctattttattcacgatccggttcaaggattttgtagatatctgagaaccagcagtaattaagagccttaaagctgataatccgtttatatttatatggttgatgtatacaggcggcaaagtggctacagtaatgtcatgccggttaatatactcttcaaataatgtataattattgatgacttgacttgaaaggatgtgtagttccgctccggtcaacagtgccatactgatttcccacactgatgcatcaaatgaaaaacttgcaaattgaataattttatcccggtaattgatattcatatcatgttcaaagacacttttgagattactgattccgatatgccggatcgttacaccctttggttttccagtcgttccagaagtataaatgacataagcaagatgttctgcggaactcatcattggcaggttatgccgatctccggtgtaaagagaactatctgttaaatcaataaccttcccgtcaaacggaatattgtcagcctgactattctgcactaataaaatgtcagaaccgctgtcttcaatcatgtatttgattctctcagaaggatatcccggatcaattggcaaaaatgcgcctcccgccttcagcacacccaatatgcctaacaccatctctaatgatttgtcagcaacaatacctactattgactcttttttcacccccattttcattagtattctcgccagactatttgatctttcgttaagttctttataagttactttattattttcatacactgccgctattctttccggtgtcttttccgcttgttcttcaaacaattgatggattgtcttattatgcgggaagtcggctgctgtatcattgaatacataaagcagtttatgtttctcatcatccgttatcatattcagtctgcagattgccgtgtccggttctgatacaacctgttgtaaaagccgggtataatgagcacccattctttcgactgtgtctttcctgaataaatgattgcaatattccaattggaagttaacgccttcatcggtttccattgcagttaacgttaaatcaaatcttgatatattgacctcagataccagtaaatttgattctgctgtctcttcatttcctccgaatccgtaatccttactctcaaaagtaaacatgacatcaaacagcgggttccggctcgaatctctttttaccccgagtttttgaacaatattttcaaattggtaatctgtattctcaaaatcttttaacgtatgatgtttgacctcttctaaaaacgctctgaatgttttatgttcctcaggaaaatttcttatggcgacggtattgacgaacatccccaccgtattctccagttcggtgtctgaccttccggactctgccgttccgatgatcacatcctgctgaccgctgtattttgaaagcatgatattatataccgccagcagcaccatgtacaaagttgttcctgtttctttcgccaccgactttaagcttgatgttaacctttcatcggccgtaaagctgactcggcttccttcaaagcttttgactctcggccgctcgtaatcagtctgcagattgagaatcggcagatctccgcttaaccgcttaagccaatactcctcttgttcctttaacgcctcttttgttcctgagcttacttgccattctgaataatctttatattgcagcggcggctgttttagtttatgatccgcatacagcgcattgaattctttgcggattattccaaccgatacaccgtccgcagcgatatgatgaacatctaacagcagcagattccggtcttcatacgttatgagtccggctctgattaacggtgctttgtccaaatgaaagggtctgataaactgcttcacatatggtcgtatcccatcagacggcagcttctgataatcaaattcgagctcccatgtatcgtgaataatctgaaccacatcgccgtttacaacatcgaaacttgtccgtaaagcttcgtgtctgccaataatctcttgtagaactgattcggctttttttacatctaattttccgtttagttcaatcataatcggcaagttataaacgatactgtctttatccgtctcccaaagggcaaacattcttttctgagcagatgacgcttgataagaagactgctttctcgctttactgatgaccggataattctgtttatcccgcttttgaataagacggctcaactgtttgatggtaggctgctcaaaaagctccttcacctttatatccgtgccgaatgtttttctgatgcgggaaattaacatagaagcctttaatgaatgaccgccgatttcaaagaaattttcatctataccgacgcgttccctgccaagtacagcttcccaaatctccgaaagttttttctccgtttcatttgtcggcgcttcatattttgtttcggacatttgagatatatcaggtcgaggaagtgcccgtctgtcaattttcccatttaccgtcaaaggcatgttatccatttgtttaaagtacgatggaaccatatattccggaagaaagtctctcagaaagtgctgcaattcaatctttgcgattttatgatttgaagtgtaataagcacagatatataaatcatcatcaccattatgatttactgttactgccgcttctttaatttctgtatgattgatcaatcgggcttctatctccccaagctcgattctaaaaccgcggattttgacttgctcgtcccgccgtccgataaactccacatcgccattttctaaataacgcactaagtctcctgttttataaagacgtgctgaaggatcattattgaaagggtgtgatataaaccgttccttcgttaaatcaggccgtcgccaatactctcgcgccagcccatctccgccaataaacagctcaccaggaataccaggcgctaccggttttaattgcgaatctaaaatgaatatttctgtaccagaaataggcctccctataggaagcgtactgcctttccaatcatgagggaccgggaaacaacaggtaaaggtcgttccctctgtcggcccatatccgttaattacttgtacctttccaagtgctaatactttttgaacatgcggaacggaaaccacatctccgcctaccaataattgctgaagcccttttaatgattctaactgctgatcaactactagagaaaataaaccggccgtcagccaaagagtcgtaatgttatatttttttacagcttctgcaatatcatcagccgtcggtattcccggaggcattatagccagacatcccccattcaataaacagccccagatctcgaaggtagaagcgtcaaaagcggcagaagctaattgcagaaacgtttgattctcatcaaataccgcataatcagtctccttcaccagccgaatcacaccgcggttaacaatacttactcctttaggcagtcccgttgagcctgacgtatacatgacataagccaggtcatccaaggaaccttttatgccaatattagatccatccatcttttcaatttcttctttcataccatccaaacagattacgccgtccccgtgaggcgggagttgtgactgaatgctttcgtttgtaatcagcaactctacacctgaatcttcgattaagaatgatagtctttgcttcggatattgagggtctaacggcacataagcaccgcctgactttaatattgccagaatactaatatacaaatcaaaagagcgttctaaagcaattccgacaaggtctccccgttttactccgcactcctgaagataccgtgccagctggttcgcacggtgattaagttctgcgtaacacattgaagagttttctagtaccaaagcagtcttatccgaatattcatcagcctgctgctcaaacacctccgaaattgttccaattttcgaataattatcttcccagccaaagattttcttttgcttatttttttctttcaggaatctcatatctttcactctgatattttcaggagttatcatagcttcaaggatcatctgaaatcgcagtgacaaatcttttatcatattttgagaatagaggcattcgttatagtgtatggctgtctctatgtattgtttctggtttataaacgaaaataggatatgaatagcgggattttcttgattaagtatgtattcttgaatattttcaaggactatcatgacatcaaaaggaaggccagtcattttatcacttgttcgagaattattttgggggctttccaatgcctgttctacggtgaattcgactttatgtatgatctcttttaataggtcttcaccatgaacagcatttttaagagtcaaaatttcttgctcagaatcaatcgttctgttctttctgaaaacaggagtcttgattacaatattttgtctttctgtatattgatttattaacaaagtcagtgccgctgttaatacgacatgcagacgttcatccgatccattgcagcatacattcagcttatcgcttaattgctgtgacaatttatatgtaagatttttcattcttttttctttagaagatttacttcccactaaaaaatgctcttcagtttttaactcaccaatactgtttttatctccctttatactttttgtcataacaaaaactccttcacttgatatcaaaattcaattcattcactgaattaaaacagcagaggctttcggtggatttttatgttaaactgcatcacaggcaataacgctcaccaataattgttgttgtagtctgacagtttatttatcggcagcaaaaaccattttttaatgatatagacccgtataaacactttttttaaaaaaaggataatgaagaagaactagccatctttaagaaatattatacaaatatttaagagttgtcaattagcagggaaaaacacctaagcacattaacccagtttttatttttcgtattaacataaaaaaaccgggacaaagtaacactcccgatttttcaatcaacaatttatctcaaggttttatttataatgtcagttatttcattcgaaaattgatgaataaaaaagtgatttccttcaaacgtataaaaattgcatttccctaaagtataatgtccccaattacatattaaatctgagcttatcgtcttgtcattaataccatgcaacactgttatatcacagtccataacagtcttattttcagaaataacatccttttctaacattttgaaatcacttcttaaaataggaagatataattgttgtaattccttgttatgtaacagttcttccgaagtcccgcccatatccatgattctttgcaaaaataaattatccggcaaagcatgaatcatcccctctgcttttttcgttttaggaatgccgcatccggaaaaaaatatgtgattgggcttcttctgctgcatttcagcaattttacaatataacttataaactaatcggcctcccatactgtggccgaataaagcataatcacactccctgatttgatcctttatcagatcatatatatcattaacagcctcatctatatgttcataaaaatcttcgttaattcttgtacctcttccttttaactcaataggatgtattgttaaagagtcactcattaaccttctccatttatagtatattgcacttgatcccctgcatacggaagacaaaatatttttttcataattcacctcagaaattttgtaataacccgataaaaaaacaccctgaaaaggatgtttttactatctcattttatatatgaaatgctcttgaaactccgttgatgatgaggaagattcctattactcttaaaatgatccttgttgttctgttatcttttccaaaagcaacttgcccgattttaccgataaatacattcatgagtacacctataattaattcagccattccaaatagttcttccatacccaatttcctcacgtcctttttgatctgttaattttatccgattattgttgatttaattttcttttttaatctccctgcttatcaagatgaaagatacaataatacttaataagccgacacttgcaaaaattacgatcggaagccattcagttcctaaggtactcttactaaagataatgttgtttaaagactgtattgcccatgcttcgggtgtaaatttagaaataacctgcatatattttggagcaatttccaatgagaaaaaggaaccgcctatcatcccgcttactgcaattatgatcgatgcggcagaagtaaactgcttttggcttctcataaatggaaccataatcatcgtaatgcaggtcaatgcaaataaataaacagcgagcataacagcgatggcaaagatgttatgacctatgctgatcttgagtaagtattttcccgcaagtattataacgattatatgaatgattccggaaatataagtagcagccattttggataaaacatattttgtatagtttataggcgtacttagtaatcggctgaaagtattattctctttttcatcaataagtgttcttaacccttgaataacaacaaaccaaataaacattacaagaaaaccaattaatctcacggtcgcattatcctgagtatgtttaccctggcttaatgttttgtcattcacttctattcctgaattgtttttcaatttcttgaaaatgttcttttctatatcttttgagtccgtatgcaactgcgcagacatatattgcgaatctttaactacctttttaagagttcccgcctcatttttgaccagctgctctaacaatgttccgctgccgttctcatagttttggatgattttcatttttatcttgtgattgtccgccaattcctttccaaaacctttttcaataacgaccccaaaaggaatatcctgatcatcgacttttttctttatttcattttccgttagctttataactttaatatttttatgctcttttatcatttcaatgagctttgcagcatagttgcttttatcagcattggctatatacaagttctctttgctatccgtatcttgggaaaaagagaacaaaaatgtaaggattaacggcactgaaatagttgcaaaaattgctaatctatttcggagcatcagcttcagctgatgtttaatcatggcaatcaattgcactactacgccaccttcttcctgttgaataccataatattaataaagacaaagatgagaccaataccaattagctcaagcaaatcaatatacatgccgctaaggccaatattctgtttgacttttaaataagagtttattgccttaccgttcggtatgatctcttggacaaccctcaagctatcaggcagtccgttcttaggaataaaactgcctcccaaaaaactaaaaatataaagaaccggagaagccatactggacaccgccacgtggtccttagcggtaaaaccccaaaacaatacaatgctgcctatagcaaatgcgtatactaccgtaataacaaaaatatcaaacaagttgccccagttcattcggaatacgacccagcttatcagaataacagcagtcatctgcattaagatcgcaaaaataatacctgtcaactttccaagcacatactgaatatttaaagtcggtgtagatttaattctgaacagcgtattattctgccgctcatcaacaatgctatgaacaagcacaaaagccgtcataatggaaaacataacaaccattgcaattgaataatactgcatggaatcgacaggaaccgcatttttatttgtcgctgcttttgggatatcagcggagatcccgtcattatcggccaaatcgttcatcattttttctattttttcttttggtacgctgccgccggggctgatatgttttattacttcttgttgctcagcactcattgttttcacgcttttcgtaaagccctccaaaacagcctgaacaatatttttatctatggtcttattattatctccaattaaatcgatatttgttttcccgttgttcataacggctttcgtaaagtgttccggtacatagataaaagctgcagcctttccttctttaactaatttttcaccgtcattgtagctctcagcttcttttaaatgaatgatatctttgagatctcctttcttaaaaactttatcctttaagacatcacctaaagaaacactctctcctgaatctgctgagtaaaaagctacatcaaatgcttcgatttttgaatctgaattactgaacacactgcccaatatgaggattagcagtgatggaaacagcatcagctttaaataaaatgacttattttttgttaacagcttaaaatcaagaaaaaataagttgaataattttctcaagatagcctcctcctactaatctcttaggtttttccctgtaatttgaaggaaaatgctttccaaatttacttcctcgtacttaaagctagtgaggtcgatccccagatttttgatatcatctacaatttcaatgatgtttctttccttcgtcgatacaagcattgaaatttgtttatgatctaccgtcactttatcaattcctgtaatgctgtttatccggctgagtgcctcttcatcagcacccttaaaagtaacagttaaagtgtcacaagcatttaagttttccttgagttcttctttcgttcctaaagcaataagagatccatgatcaacaattgccaccttctcgcaaagatactctacttcttccatatagtggctggtataaataacagtcattcctttttctttattcagcctttttactgtttcaagaatatgatttcttgattgcggatcaattcctacagtaggctcatcaagaattaataatttaggattattcattaacgccacgcctatgttgacccggcgtttcattcccccggaaaactctgatacattttgattttttttatctgtcagttcaataatctccagaacctcatcagttctttcttttagctttttccctttcagcccgtaaaggcttccgaagaagttcaagttatctttggcgcttaacgtttcatataaagctaaatcctgtggaacaacccccattattttttttatctcaataggtttttccttaagtgatttattatctactttaattgtcccgctggtaggtgcaagaacagtgctaatcatagaaaccattgttgatttgccggcaccgttaggacccaatagtccgaatacttctccatcttctacagtcagcgaaatattattaactgccgtaaagtcatcatattttttggtaagtttttttaattcaagcataattaaaacacccctcgtggtatttcggttcttttattttaacctgaatggaatatttttagaatttactatagtactcatttaccttattactttagttacgaatcgcatcgttactttagtcatatacggaaggtgtaagtccggatatattcagaagaaaatggaggaaaggaatttgatgaaattcctttctgattgaaggaaaaaagttgaatcacatatgcttttgtaaatataagctaagctccgttcggttgttcatttgaagtttttccagtattcttgatacataatttttgactgtgccttcagtaataaacagtgcttcgcttatagctttgttgcttttcccttccataatctgtttagcgacttctttttctctgggagtaagcaattgcaccagctgttccttttcattattttcttgaacaagctctttattatgttctaccgaatttagagcctttacaacttttagcgttaccttaggatttaacagaatattgccttcacatgctgttttgatggaatcaataatttcttgtgaatcagaatctttcagtatgtaaccatcagcaccgcttttcagtccagtaaaaatgtattcactatcgttaaaggttgtcaggataatcactttaatatccggatatctctctttaactagctttgttgcttcaatgccgtccattacgggcattcttatatccattaaaatgatttcaggccttatctgttttagcaaatctaataaatgttcaccattagaagcttcgcctacaatattaatttcctcgtgcagactcagaatcattttaagcccttccctgacaatttgctgatcatccacaatgataatatccatatcaatacctcctcacattccgattaaagatctgctatctcggggattacggcttccacagtaaatcctgaatctagccctgaataaaaatcaacctctcctccaagtgcggcaaatcttttttctattccgtttattccatttgacttattaatttcagaacatcctgttccgttatcagttatcgatatagagattttttcaaaagacttacgtatttttattgaaaaaaacgtagcatttccatgttttatcccgttggttatagactcttgtactgttttatagagacaattcttgatatctggatcagctgactctactttattgtccatatcaagctcgaattttatttcatttgtttgctgaaaattttcaaaaatctcattgatcgatttcagaagccctttttgaggagcagggtcattgagcaaagcgacagcttctctcaggttaataatacactccttcgataaatcatgtgacttattgatgacttgtttagcctcgccgggatttttacttactattttatcggcgaattcaagattcattgttaatgcgatcaaataatgccccagggaatcatgaagctcttgtgcaattcttgtccgctctttagaaatagttaactcttgaattttttgagaataattcttaagtttagtgtttacactttgtaattctttatttaatgtttgtatttttgctttttcgagcagtacgtttctaaacagataaataatagccatgatcactaaataggacatcaatatatctttcccgctggtccctgctgctttaagagctgtaaaaaaaataataaaatgcagacttactacagtccagggcagtttacgagttgttacaataatctcgatcagtaaaaaaatattatatatttgagaaccgagacagttaattttaaacaataaaatgcctgataaaaggttacttactaaaaaagatgcataatatctaaaagaatactgaccgcttaggtattttaatctgatatgatcgttgacgactaaaaaaatggtgataatcagcaggtaagcggattccgaagccgtaaaagttggcgttttaaaaatagaactgataatagaatataaggaaaaacaaataatggttttctctatgagcactcttgtactaattgaagaaagatttttcataataatccttcccgagacaacttgatataaattatattatacatatattgagaaatcataaagcgacaacctccacgttcagcacatcatacagctcatcaagcgaatgaatttcatacgtcgggataatcccggactcatttgctttctttccgggattaaaccagcacgtatccattcccgccatctgaccgccttttatgtccgcgctcaatgaatcgccgataataagcccgtgcccggcagaaaaaccgggaattctcgcaaatacataatcaaagtattccttcatcggcttttgaaaacccgtgtcctcagatacaaacacatctttaaaaaacggatacagaccggagtcgcccagccgcttatattgtgatcttgagacgccgttcgtcacgatgtataaatcaaataaaggactcagccgttcaatcagctcataagctccgtctatcatctggtgcccttcttctaagtattggcggtacgcctgattcatcagcacgccgtcggcttcaaggccgtattctttaaacaaaagggcaaaccgtgtattcaccacttcatcgcgggtcatttcccctcttcaaacgccttccacagcccttgatttaacgctttataacgggcttccacctctgccgtcagctccagctttgaaccttggaacaatttttgaagagcatcggtttctgaagcggtaaaatccagcagcgtattgtctatatcaaataataacgtacggtaatgactcatcgatgtttcccccggttctgctttttttaaccagtataccactcgcggacaagccgaaaaagacacccctgtaagagaggtgtctttttgaattatacagcgtcttctattttcgatttttcaccaggcatgcgcttgccgataccgaacgcataatagctgaccgtcacaatcgccaggaaaatcaccccgacaaccaaagaaatccgcgtatctttgttaaaccacatgccgatcaataccatgagtaagaaagcgatcgtcaaatagtttgtaaacggcgcaaaaggcattttaaacggatgcttatcaagctcagcgcctttcgctcttctgaaaccgagatggctgatcaaaatgacgaaccacggaatcattcccggcagcacactcgcgctgtacacataaacaaagattttcggaggcgcgatgtagttcagcacgacaccgatcacaagtccgattaataccgcaagcgtaccgaatatcggcacaccgctcgaagaaactttcttaaagaatttcggtgcctgtccgttcacgcctaacgtataaagcatacgtcccgcactgaatatcccgctgttgcatccggacatcgcagcggtaatcaccacaaagttaatcagaccggccgccgccgtaatcccgactttcgcaaatgtcgaaacaaacggactgccgagtgagtgaagctcattccacggatatacggtaacgattacgaaaatcgcaccgatgtagaaaattaaaatccgccagataatactctgaatcgcgcttcgcagcgttttttgcgggtccttcgcttcccctgccgtaattccgatcagctcgaccccttgataggccgcaacaaccaaagacaaagcaaagaaaaatcctgaaaaaccatttgtaaagaaaccgccgtgcgaccataaattagataatccgatcgcatgccctccgttaccgaaaccgaagaaaataattccgattccggccacaatcatcagaataatggtgacgattttgatcatggcaaaccaaaattcaaactcaccgaaagattttactgaaattaaattcgccgcaccgagaatggccatggcgataatgccgggaatccatgccggcagatcaggaaaccaatatttcatatacgaaccgacggcgataatttcagacatcccgacgatcacccattgaaaccagttgctccacgccgtcatatagccggctaacggatgtatatacttatggccgaatgtcgcaaacgaccctgtactcggctctacatagagcatttcgcccatcgcacgcatgataaaaaagataaagatacccgagatcgcataagccagcaggacagacggcccggtccatccgatcgtgctggatgaccccatgaataaaccgacaccgatcgtgccgcccagcgcaatcatctgtatatgacgagcgcctaagcctctctttaattctttgtttgccacttcgcttcctcctcttaacagctctgatatatgtgaaataatgaagcagaaggtgcacctgttgaacctaactcactcttcatttcccgcaatattggaaatattctatcttcctatcgttatataatctccaatttccttattccatcataataaattttcgtggaaaatacaattgtttttttcaggcaaacaccttacactctgaaccaacggactaaaaataaagcgctttcatttttattgaattgtgaatattgagataataaatgccgcagcctccgagaaacattatttcccaggagaaacgttttccgccccctatccaatattatttttgctaagcagaatggcgtaaagccttactctcttccattctcccttgtatacgccataatcctgcttaacccggcaaaaatcatgcattaatcgataaatgcctcattcagccgcagcaaaagccggccgaacatttctttttcatcgccggaccaatcgtcaagcatacgatgataccgctcaagacgcatctttttatcagcttttaacctctgtttgccaagcttcgtaatcgcaaacagactgacccgcccgtcagaaggatcggaaaaacgctggatcagctctttcgactccaaggccgctgcctggcgtgataatgtggaaatatccagcttaaatgattcggccaattccttcacacgcgccggcccgaattcatccagctgccgtaataacaaatacgcagccctttccagatgtccgattttacggtcggagttatcaagataaacagctctcctgatgaaagtggtgagttcatattcaattaattcaatcggatcttgttttgacaaacgcctcactccttacattgacaacagcaacattagttgtataatacaaacatatgcacatttactcagaaaacatatagaaagattttgcatacatatatttgtatagtacaaatatatgtgccaaaagtaaagaaacttatagaaacatcaagaaagggggaagctgctcttctccaaagaacagcatcgttgtgaaagtcatacgcatcatcttgcaaatcattattttattcgcattttcctttatcgggggagccgttcagcagttctttcacctgcccattcccggaagcatcatcggtttgatcctgctgatcatatgtttatcggttaagatcattcccgtcaaaatgattgaagacggagccggatttttgctgtcttttcttccgctgttattcattccggccatgacgggcgtcatcaattacccgtcactgttttccgccagcggggctgctctgtttctgatcatcgtgctgagcaccatcgtcacaatgatcgccgcagggtacgccagccagctgttagagcataaagccaatcagagaaaggagaaaaagaagtgcagcaagcatgtatcgcaatccttataattttgttcacggccgccgcctatctggctatggtgaaattatatgtgcgctttccatacccctttctcataccggttttgacgactacgattttcattatcgccgtgctgcttgtttttcatattccgtataaagactatatgatcggcggacaatggatcaattcactgctcggccccgctgtggtggctttggcatacccgctttataagcagcgccgggtgttaatcaagtatatgtttccgatcatcggcggcgtgttggccggtttattctccggaatggtcagcggcctgctatttgcagagctgttcggcatcagccggagtttgattttgtcaattatcccaaaatcaattacgacgcctgtcgccatacagattgcgtccggtatcggcggtgtcccttccatgacagtcgtgttcgtcatgatcgcagggttttccggcgttatcttaggaccgctgcttctcaagtggatccgcatccgcagctcactcgggaaaggaattgcattcgggagcgcctcccatgcgctcggcacctcaaaagcaatggagtacggagaattaacggtctccatgagttctgtttccatgacgctctgcgccgtgttagggtcggtcttcggccccgtcgtagcatggatgtttcaaatttaaagccggcggttctccgtcagcttttttcatgtgcggatcatctcatttccttccattattatgtttcatttgtaagaataatggtaaagtagaaaacaaggagggatttaatgatgactggggcaattccgcaaaagaaactgcttgatgggacaagcattcccgcgatcggcttcggtacatacgctcttaatggaaacaatggcgttcatgccattaccagcgccattgatatcggctaccgtctgattgacaccgcttataactatgaaaatgaagggacggtcggagaagccatccgcagaagctctgttccgagagaacagctatacgtgacgtccaagctgcccgggcgctaccatgactatgacaaagctgtacaaaccatccaagaatctttataccgcgccggtctggactactatgacctgtatctcgtccattggccgaatccgaaacaagaccgctacacggaagcatggcaggcactgattgatgcgaaaaaatggggcctgatccgatccatcggcgtctgcaatttcctgcctgagcacatcgaacggctcgaacgtgaaaccggtgtaaagccaggcatcaaccaaattgaactgcatcccgcttttaatcagcagcagcagcgccaatggcacgaagaacagggcatcgtgacagaatcatggagtccgttatcccgcgccggcgaagtattgaacgatcaaaaactcggacagattgcggacaaatacggcaaaaccatttctcaagtcattttgcgctggcatatccagctgggcgccatcccgattccaaaatcagcatcgcccgagcgccagcttgaaaacatctctgtttttgatttctcccttgatgaaaacgacatgagcatcatcgactcgcttacccgccccgacggacggataaacggccaagacccggcggagtatgaggagttttaaaaaaacacataaagaaaagctgacggcatcatttgtcagctttttcaccttttactctgggatagccaagactgtgaaactttgcagtaaaggctggaaacacacttatcctattataaattgatcagctgctaaaattcttttttatgatatatagctgcggcgatgaaaaatgaaatgatatataagataacgccgatcatgagatatataatcgggacatataaagaaggatttatgtgcaaaaatgacagcggtacttgttctgctgcatacccaacgacactttgcaatccaaaggtagcaaaaagtccccccattgcccctccaatcacgatagcatcggatttttccgggcctatcatgtagagaagaggataaacgattgcaccggcaaagagaacgatgaacgttccaaaagagacaatattaaatataccgtcaattggttcatcagaacccaggctgtatacaaggaaaataccataagatattacagctccgatcacaacaatcaaaagataaaagaaatagtgactttgaacaatatttgttctgctgaccggtaaagtcagaacatacctgtcatagcctgacttgctctcatactttataacctcaagtgcgggcataacgacaaacaaaataatcagcatagcaacaaaacgatgcattgaagcatccccaaaataaaaaatgactgctgataccaatatggccaaccccgtgtatgcaaagaaactccgataaaccaagtaatagttagtcagtaacagacctctcaatgttttcactcctcgttaaaaagacgctgatttcttctatggaaatggtgttggccgttacgccattcggcaatttctgttgatccgatacaagcacactccaataagatccatgattcctttttgctagaacgatatcttcgtcaatctcagccaattgaccttcatcaacgtctataacggtatagctttcaagaaccttatctttctcttcatttaataaaatttcgccatctttcatcataatgatatggctggctatcttctcgacatcagtcataatgtgcgatgaaagtaaaatacctccgttgcttttactcacaaagctttttaattcatttaacagatcatctcttgaagagggatcaagccctcccgttgcttcatccagaagtaataattttgcattatgcgacaaagcaacagctacagataacttcattgacatgccgcgcgagaatgtattcacttttttatccataggtaaagagaaagaatgaaccaaccggtaaaattgatcttggtcccaagcgtcgaacagtttcttaaatacatgattcagctgctttatcgtaaggtgcgcgggaagattcatcgcatcaaatacgaccccaatatcttctttaaactttatatgtttatccagattctctttaccaaagattttcactttacctctatcctgagagattaatcctaatatcgttttaaatgttgttgacttgcctgcgccgttatcaccgataaaaccgacaattgatccggcaggcacattgaatgtaacatcctttaaaacagctttatgaccaaaagatttgctgatgtttctgatttctaaaaggtttgacatcattccactcctatcattgttgtcaggacttttttaagaattgaaccggattattgtaaaaatgttgtgattttcatatctggtctaggtattcataatggatcaggagtcgggaaatacaaaagggattttaaagtcttaagcataatatggaagtgtaatcgattgattaggtttatataatgggatattcatgatgaaaactgctgaggtgtttactttccgatgaggtatacacaaaatgatttactaatgattacatttatggattttaaccggaatgcatctcgtattataaagcaggtgttactccttttcaatatataaaaggggatttctttacaatcgcaaagagtatgcatttctcatttccgcattaaaaaacccctctggctaataaccaaaggggttaaatatattattccacagtcacgctcttcgcaaggttgcgcggtttatcaacgtcacagccgcggtgcagtgccgcatagtaagcgatcagctgcaatggcacaacagaaaccagcggagcaagcgcagggttgacttccggcaggatgaatctgtcgtctgcgtcttctaagcctttcagcgagatgatgcaagtgttggcgccgcgggccgcgacttccttcacgtttccgcggatgctcaggttgacgtgttcttgtgtcgcaagcgcaaagaccggtgttccttcttcaatcagagcgattgttccatgcttcagctcgccgccggcgaagccttccgcctggatgtaagaaatctctttcagcttcagggcgccttcgacacacacgaagtagtcaaggccgcggccgatgaagaaagcgtttcttgaaacagtcaggtactcacgcgcgatcatttccatttcgtccttctggtcgcagagggcttccatggcgtttgccgcaatacctaattctttgaccaaatcaaaaccgatatcaacgccgttgcgttctgctgcaacggacgcaacgatcgcgaggacggcaatctgagccgtatacgcttttgttgatgcaaccgcgatctcaggacctgcgtgcagaagcaatgtgtaatccgcttcacgggaaagcgttgatcccggaacgtttgtaatcgtcagcgctttgtgacccagcgctttgacttgaacaagcacggcgcggctgtccgctgtttctccgctttgagaaaggaagataaagagcggcttcttagacagaagcggcatgttgtaagagaattcactcgctacatgcacttcaaccggtacgtttgcccacatttcaatatattgtttcccgacaagaccggcgtgatagctcgttccgcaagccacgatataaatgcggtccgcttccgccacggcgtcagcgacatcgcccgccacggccagtctgccgttttcgtcctgatacgtttggatgattttgcgcataacaagcggctgctcatccgtttcttttaacatgtagtgagggtatgtgcctttttcgatatcactggcgtcaagctcagcgatataagacgcacgtgtcatgacttcaccgtcaagatttttaatcacggcttcgtcttttgtcacgatcaccatttctttgtccaaaagctcaacgtattcattcgttacttgaagcatagccatcgcgtcagatgccacgacgttaaacgtatctccaaggccgattaacagagggcttttgttttttgcaacgtaaatggtgtctgtgttttcaccgtcaaataatgcaattgcgtaagagccttttaacagagtcagtgttttgcggaacgcttcttctgtgctgagtcctcccgccacaaattgctcgatcatttgaacgactacttcagtgtccgtgtcgcttttcagttcaacgttttcaagatactcgcgcttcagctgaacatagttctcgatcacaccgttatgaacaagtgtaaagcggccgagtgcgctttgatgcgggtgagcgttcaggaagcttggttcgccgtgagtcgcccagcgtgtatggccgattcccgcttgagattcaaccgtgtggtccaccacttcacgaaggtcggcgatgcggcctttttctttgtacacatgcacgccctgctcattcgccacagcgataccggcagagtcatagccgcggtactcaagcttctctaatccttttaacaaaatctctttcgcatcaagctgaccgatgtaacctacaattccacacatattttcttcctcctaaaggtgtaaaaggagacgaagaaagtcaaattacaaggggactttcaatcgtcccctcccacatgtttttttggaagatcatgtgatttccctttgttcggagagtcgcccctccggtttgaagaaatccttacggctgtgatctaaatgaatcagccgggaggcatccgccgaaaattcgataacctccatcctcgtcaactaagccgtttttcgggcgcttagttcgggcgctgtaattataaaagatgcaaacaatcccgcctttcctgcaagtgaaaaacaaaggctgaacaagcttgattttacagcatgtgccaaggacggtcaattattttttgccgccccggcatcatgtttactatcattttatgctgatcgcacttgtcttgttcgctctctgcttataaacttcgctactccgctcccatttctgtccgcacgacatccacgatttttgtgacatattcgtcacaaagctcttttgttctcgcttccgccatcacgcgtacgagcggttcggtgcctgacgggcgcactaaaatccggccgtctccgttcatttctttttccacttcagaaatcacggccttcaccttagcgttttcttctaccttatatttatccgtcactttcacgttcactaagagctgcgggaattttttcatttcatccgcaagttctgaaagggttttgccggacgccttcagcgtattcacaagcatgatcgcggacaaaagaccgtcgccggtagtgttgtaatcaaggaaaataaggtgccctgactgctcgccgccgacattatagccgtcttttttcatcgcttctacgacatagcgatcgccgactgccgtttgaacgcttttgatttcttctttttcaagcgctttgtagaaaccgaggttgctcatcacggtcgatacgacggtatcatccttcagacggccttctgatttcaaatacttcgcgcatatgtacatgatctgatcgccgtcgacgatgtttcctttttcatcaacggcaatgaggcggtcgccgtctccgtcaaacgcaaggccgatatcggcgtttttttctttgacgaaagcactcagcgcttccgggtgtgtagaaccgacgccatcattaatgtttaatccgttcggagacgtccccattgtagatacgtcagcatcgagatcggcaaaaaggtgcgtcgcaatggaagatgtcgcaccatgggcgcagtcaagcgctacatgaatgcctgtaaaatcttcgtccgccgtctgttttaaaaattgcagatacttttgaacgccttcaaaataatcgttcacaagcccgaggtccgcgcctgtcggtctcggcagcttatcttccggttcctccatgagacgttcaatctcggcctcctgctcatcagaaagcttaaagccgtcccctccgaaaaatttaattccgttatcctgtacggggttgtgagaagcggagatcatgacgcccgcctcagcatccatggctttcgttaaataggatacccccggcgtagaaataacgccgaggcgcatcacttcagctccgatcgataaaagtccggcgacaagggctccctccagcatatgtccggagatacgtgtatcacggccgatcagcactttcgggcgctgcttatctttggtcaggacataaccgccaaaacgccccactttaaaggccagctctggcgtaagctcgctgttggcaacacctcttacaccatctgttccaaaatacttgcccattttgtatcgctcctttttcattctgttgaagaagaatcagcgcttgatccgtcttcatcctggtcttgattttgatcctggttttgacttttattctgatcgctgtcagtgtcgtcttcccggttcttgttcttgtctttgtctgcgtctccgcttgtgccgttcttattgccggaatcagcggagccgccgtcatttttatttgaacttgtgtttttcttagaagtcagcttgatcttaaccgtgtcttttgacagggaccatgtgacgttttgcgggccgtttacttcaagctttacagagtgctctccgtcatccaagtccgagacattggcatacagttcaatgtccgactttttcagcgccttaatgttggcgggagagcctttggccgtaatatttatcgcctgcgattcagggtcgagaaactcaatctgctgtgagcctcccagtccgaccgtcttgattgcgacattgtcaaaatcctttttgtcttcactgtccactttaacatgaagcgtgattttttccggtgataccttagtgacacccttaggaagcgggatatcggcattgatatcggtatctttatcaattttgcctaaatcaagagatacgccgtcaataaattcaagtgaatccagcacatcctgcgggccgtaaaccgtcacctcactcggattcgagtcaatgctcgcaacgctcaccccgtccggaagacttcccttcctttcgattttgaaaggaagctttttgctcggactggctacgggaaccgtcactttaatgactgacggttcaacatcaacaggaagtgcgttgccgtctttgtcatagacggtcaccttcacttccttttcaatggtctcatttgcattttcaaggttcacagatgctttgacaagtgaaatgttatcaatcacatttttcgaacctgtaatctgcacgtttttcgggctgataatcggctgctgaggggtatatccctttttcattttgcttttattgtagtattcaacttccacgggaaaactctcagccgttttttcctgaatcgtaaccgtcgtgactgacgggtttatggagatcgtcagtccgtccgatacgtttttcgccttcaattcgaccttatgagtcccggtcttcagcttattcatatcggcgtatatctcaaaattcttcgtctgtctcgcctttttcaccgcgcttgtcgagcctttaatcgtgacatttaccgtctggggcacgccggtgacgacatagttcgcttcatcgtagtatgcttttacaggaatatcagtaagcgtagcctcgtcagtcgttgatgtcggaaaaaaggattcccccggctttttcggagtcggcgcctggttgttgttaaccgcaacgtaaagcagcagcgccaagagcaatgcaatgatctttacagcccagcggttgtttaagaatttatccatttttcttgcccctccagtaccagcggttagaagaagtgtctctggcgttcttcttaaactcggcttcaagcatttctttcagtgcttcttccgtcaattctctgtgaaggtctccgtttctggccacactgatggcgcccgtctcttcagatacaataatggttaagctgtccgtcacttcactgatgccgacagccgctctgtgacgcgtccccagctcctttgaaataaacgggctttcagaaagcggcagataacaggcagccgcagcaatctcgttatttttcataatgaccgctccatcatgcagcggtgtattcgggatgaagatattaatcaaaagctccgagctgacctgcgcattaagcgggatgcccgtctcaatataatcgcccattcccgtatcgcgctcaatggcgatgagtgcgccgatgcggcgtttcgccatgtagctgatcgattttgtaatcgcttcaattgtcttatgctgcgcttcctccacaggggttccgctcctggaaaagaaccggccccgtccgagctgttcaagcgcccgtctcagctcaggctggaatataatgatgatcgctaaaaatccccatgttatcgcttggtccatcagccactgaagcgtgctgagtcccaaatatgaactggccatccggaccaatacgatgacgacgattccttttaaaagctgaaccgccttcgtcccgcgtatgaccatgattaatttatatatcacataccaaacaaggagaatatcaacggcattgccgaggtattgcaaaaatgggatgtcctcaaaagccatttcctcgtcctccaagaattcagtcatttcgttttttccgttatgaattgtgctgcatgagcaatatgtacatcatatagcgtgctcattataccacattttgatttctcaagtgaaatgagccggcgcggcgttgcacaaaaaaagagtaaagcgattatacgctttactcatcttcattcgggtccaaagcgcttacgacgccctgtcccgccgatttcagttcgtaccagacccagtcaaacaattggttaatctcttcaatctgcccggtgacttgtccggctgaggccatgtatttttctccgttgacgacggtcacattgccgtcgacttttccttcaatgaacagcttgccgttttttactgtgacatcgccctttacggtctcgccttcagggacggtgaccgtgtgattctgcacgacaaggttcggctgtttggacacactgaaattgtggtcattatgccagctgttgaaaaaaccgccgcccattaaaatcacaaaaaccgctgcggctgcaatcatcggatgagttttgatccatcgttttacagaagcgcgttttttctcttttggaagattcgccataactttggcagtaaaatcagcaggggccgtgacatgcgatgtgcttcggacgagtgctacggatttctccatttcatgaaaatgccgtttgcaattcccgcatgactgcaaatgttgttttaatacgttttcatcttcaggaaggatatctccatcaagatgcttatgcataagctgcacaatctgttcaggacagctcatttcatcaccccacttaaagatccctcaattgttttctaagagcctctctgcctctgtgtatccttgtcttgacggtgccgacagggatattcagaatctccccgatttcaattaaagagagttcgtcaatatactttaatacaataaccgttctgtacttgtcaggcagctttaaaatctttttctgaattgtgtccgacagctccaatgacaatacggcgtcttcagggagaaccccgtccgcggcgatctgcgaatacatcgtcagcccttctgctcccgctacttctgcgtccagatagtaatcaggctttttcttgcggatgcggtcaatggtcaggttggtcgcaattctgtaaagccacgttgaaaactttctgttgatatcgaaactgtcgatattgacatacgctctgataaaagcttcctgcgcaatatcttccgcttcgtgaacattgccgagcatgcggtagcaaagctggtaaatcttatctttataaaggtcaacgatttctgcaaacgcattttgatcgccttttttgacttgcttgattctttttttaatcaggttttccatgttttatcttacctctgcccttcaccggtctgtatctatacgttgattgttttaaaaggtttcatttttttattacatttattttaccaaatttcaggcagggtgtagatggaaaatacagaatatactgccttaacagcagcttaaaaatagtatatctgatgaacaatcaaaaaccgaaacaaaatgccgataaaaaaagacacctttatgcaaaaggtgtctgagactgggctagctggattcgaaccaacgcatgacggagtcaaagtccgttgccttaccgcttggctatagcccaaaaatggtggagggggcagattcgaactgccgaaccctgagggagcggatttacagtccgccgcgtttagccacttcgctacccctccgtatttttttggaaaacagtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatgacccgtacgggattcgaacccgtgttaccgccgtgaaagggcggtgtcttaaccgcttgaccaacgggccgctgtgtccgcgtcgagctgacaaaagttattatatacaggttgtaccccatttgtaaagagaaaaattattttttttattttcaaacttttttacccgttttttaactgaaaaactcatccctcctctcttatttcatttatgatgaaagtatcaaaatattgaagggaatggacacagatgatcttagtcagctcttgtctcggcggtatcgaatgcagatataacggctctcacgccgcttcggaaaaaatccgcagactcgtagaagaaaagaaagctgttatggtctgccccgaacttttgggcggcttcaccactccccgcgaaccggcggaaatcatcggcggcacgggtgaagacgtgctgaacggaacggcaagaatcgtaacggcatcaggcgaagacgttacagctttatatatggacggcgcggaaaaaacgttagcatacgcaaaagaaataggcgccgcaacggtcatccttaaagaaaacagtccgtcctgcggcagcagctttatctatgacggcactttctcaggaaaaaaaatactcggagacggcatcacttccgctcttttaaaacgggcaggctgccgtgttctatcagaagatgaattggatcaattataaaaaaggagagtagatatcatggatgtagccctgtccttttataaaccggagcatgcagacgggctgaacgggtttgtgctgagtgaagaagataaaaagttcacagctctgccgatagatgtcctgccgcaggcgcttgtcatccgggatcgctacccgacagtcattttaaaagaagaccgccccgtcggtttttttattttacatacctcaaaagaaaccattgctccgtattcgaacaatgtgtctgccattttgctgagtgcgctgtcattacatgcgccgcatcagggaaaaggttatgccaaacaagcgatgctgcagctccccgcttttgtcgcaaattactttccttggtgtgatgaaatcgtgcttgctgtaaaccatcgcaatcaacgtgcaaagaacctgtaccggtcttccggttttattgacaaagggcggcgcaggatcggcccgatcggtgaacagcacattctgcatcattttttgtgaaagcgcttgattattcatctcatccctgccgatttttcttgaaacatctattcagaagcccatatacttcaagtattaacgacttgggagggtacaatcatgacagaccggcttaacattcacagattgaccacagaaaccagaaatccgcagaccgcttcaatccatcaggcagacacaatggaaattctccgcatcattaacgaagaggatttcaaagtggctgaagccgttcagcaggtgctgcccgatattcagattgccgttcaattcgcccatcagtccttacggcgaaacggcaggctgatttatgcgggagcgggcacaagcggcagactcggtgtactggatgcggttgaatgcccgcctacatacagcgtaagtcccgacaccgtcatcggtctgatggccggaggggcagacgcctttttgcaagcggctgaaggtatagaagacagcgaggaaaccggcgctctcgatctcaaaacgatcgggcttaccgcagaagacaccgtgatcgccatcgcggcaagcgggcgcacgccgtatgcggccggtgcgctgaaatatgcaaaaacaatcggcgccaaaaccgtcgcgctcacatgcaataaggactccttgatcagcacctttgccgatcacagcatcgaagtcattgtcggccccgaagtgattacagggtcaacacgaatgaaagccgcgacggcacataaaatgattctgaacatgatttccacggccgtgatgattaaaagcggcaaagtgtacgaaaatttaatggtggacgttcatgtcagcaacgaaaaattgaaagaacgcgcaatcggcattatccaaagcatcacgggcgttccgtacgacaaggcaaaagaaacgcttgaggccgcagacagccatgtcaaaacggcaatcgtcatgctgaagacgaattcggacgaaacacacgcgaaggcactgctcaaagaatcagaaggattcattgataaagccattgaacagcacgtttcaagagaaaaagaacgctgatcgttctttggagaaaaatattgtgcttttacgagcccgcgccgttttcatgttcggcgcaggcgcttttaggacgcgtttcaggcatagctccccgggaaaaatcgtacagaaaaaggaggatctccatgagcaaagaggcattttatcagtcactggccaaagatatcctggacaattgcggcggttcatcgaatatttcaggctttacccactgtatgacacgcctgaggattacacctttagatcgggacaaaacggatattgaggcgctgaaacggcttgacggggtaataggcgtcgtcgaagccgaaacactgcagatcattctcggcacgggtgtcgtcaatcatgtcgccgacgctttcgcaaaacttatgccatccggaaaaaacattgatttaaaagaagccgcctcacggaaaaaagccgatctcaacagaaaaaacaccacacccatcaaattgtttctgagaaaaatatcaagcatcttcattccccttattcctgcactcattgcatcaggtttaatcaccggtattacgaaagccgtcattcaggccggctggctcccgaaagaatcccaaatcgcacttattttaacggttatcggttcaggcttgttcgcttacctcggcgtccttgtcggcatcaatgcggcgaaggaattcggcgggacacccgcgatgggcggccttgcgggcatattgatccttaaccctgagatcgccaatatcagtttgttcggagagaatctgctccctggcaggggaggattaatcggcgttcttttcgctgcggtttttatcgcttataccgaacggtttatcagaaagtacgtccatcaatccatcgacattatcgtcacgcctacattgtctttacttatcaccgggctggtgacatatgtcgtttttatccctgcaggcggttttatttctgatctgattacatcaggtttattgtcgctgctgaatgtcgggggagtgctctcagggtttgtactgggagccgccttcctgcctcttgtcgtcaccggcctgcatcagggcttgactcccgtacatttggaattaatccgatcaatcggagatgacccgcttcttccgattctcgcgatgggaggcgcgggtcaagtaggcgcggccttcgccatctttatgaaaacaaaaaaagcctcattaaaaagagcgatcggcggcggacttccatccggtctgctcggaatcggagagccgcttatcttcggcgtcacgctcccgctcggccggccgtttttgacggcgtgtttaggggcgggaatcggcggcgcctttcaagcccattttcaagtggcgactttttcaatcggtgtctccggccttccgctctcgtttctcgtacagccggctcaaatcgttttgtatatcatcggtctcttcatctcttacgcggcaggctttgtcttcacttatgcgttcggatttaaggatgacatggctgctgaatttgaataaaccgggagggatcagaatatgaaaacactgacagccgccatactcacaatggtcatcagcctctcttttctgccgcagcacaaagccgaagcccaatccaaattatacgacgcagcaaagctcagaaaggttgatcaaatgattgaaaaagacatcgcagcaggattccccggagccgtcctcatcgtcgtaaaggacggacgggtgatcaaaaagaaagcatacggctacagcaaaaaatatgacgggaacacccttttatcccgtccgaaaaaaatgaaaacatcaaccatgtttgatttagcttccaatacaaaaatgtacgcggccaattttgcactacagcgactcgtcagccagggaaagcttgatgtgtatcaaaaagtctcggcttaccttcctgatttcaaagacagaaaaagcgatccgattcaagaaaaagaccgtatacgcgtcatcgatgtgctccagcatcaatccggtctgccggcaagcttttatttctatcagccggacaccgcaggccctttatattcacaagaacgggataaaacaatccgttttctcacccagatcccgcttgaatacaagccgggaacaaaacacgtatacagcgatatcggttacatgattctcggatgcatcattgaaaacataaccggaaaaacccttgatacctatgcggaacaagaactgtacaaaccgctgaaactgacgcacacactgttcaatccgctgcaaaaaggttttaaagaaaaagcattcgcagctactgaacgtttaggcaacacacgtgacggagtcatccatttccctcacatcaggacatatacgctgcagggggaagttcacgatgaaaaagcattttactcaatgggaggggtgtccggtcacgccgggctgttttccagagctgatgatatggccgtccttcttcaagtcatgctgaacagaggcagttataaacacgtttctctcttcaataaaagaacggccgatttgttcacaacggcggcatcctctgatccgactttcgctctcggctggcggaaaaacggcagcccggatatggagtggatgttcggaccttatgcaagcaggcaggcatacggccatacgggatggaccggcaccatcacgattattgatcccgcttataagctggggatcgcacttttgaccaataaaaagcattcccccgtcgtcagccccggtgaaaacccgaatgtttttgaaggggatcttttcccgaccggaagctacggcagcgtcataaaagcgatttatgaagccattgaatgacaacccatgtcttttgtccaaactatgacggcaggagggcaccatcatgaaacttttcatctcagctgtattactgttgttcattgtattcggcacgcatcatgcatcaacaaaaccggacattccgtcacaggcggaacaagcggtatcccgtatgacgttagatgaaaaattagggcagatgctcatgcctgattttcgaaattggcaaaaaaaggggcagtcatcacctgaggctcttacccaaatgaatgacgaagtcgcagggcttattcaaaagtaccggttcggcggcgttatcttatttgcagaaaatgtaaaaaacactgagcaaacggtacgcctgacagatgcctttcaaaaggcgagccctgacattccgctattattaagcattgatcaggagggcggcatcgtaactagacttggtgagggcactcatttcccaggcaatatggcgctcggggctgctagaaaaacagcctacgcgtcccagaccggcgccattatcgggaaagaactgaaagcactgggcattaatacgaatttcgcgcccgttctcgatatcaataataatcccggaaaccctgtcatcggcgtcaggtcgttcagttcagaccgtgatctgacagcttccctcggccttgcctcaatgaaggctcagcaaaagcagaatgtcgctgccgccgtcaaacatttcccgggacacggcgacacggatgtcgacagccactacggtcttccgcttgtcacccacaatcaagaaaggctgcgtcagattgaactttatccgtttcggcaggccattcaggccggagctgatatgatcatgacagctcatgtgcaatttcccgcttttgacgatacaacctataaaagcaagctggacggttcagacatcctcgtacccgccacactctcgaaaaaagtgatgactcatcttctccgtgaggaaatgggatttaacggcgtcatcgttacggatgcattaaatatgaaagccattgccgatcatttcggtcaggaagaggcggtcgtcatggcagtaaaagcaggagtcgatattgccctgatgccggcccaagtgacatcgctgcaaacggaaaaccgctttgcccgggttcattccgcgttaaaaaaggcggtacaaaaaggggatattccgctgcagcaaattaacaaatcagcggaacgcatcatttccctgaaaataaaacgagggatatatcccgcaccgaaagagacaaatctgaaaaagaagattgcaaaagcaaagaaaaccgtcggcagcaaaaatcacctgaaagctgaaaaacaaatcgcggaaagatccgtcaccgtcttacaaaacaaaaaccgcacgctcccattcaaaccgaaaaagaacagccgcgttctcattgccgctccttatgaagatcaaacagcggcaatggaacaaaccattcggcagctcatcaagaagaaaaaaatccggccggtaaccatcagtaaaatgaacttcgccgagcgcacatttcatgatgaacacaaaaagctggtatccgacgcggattacgtgattacaggctcctatgtcgtaaaaaatgaccctgtcgtaaacgacggcgtgattgacgattccgtcacagatcccggcaagtggacgaccgcatttccgcgggccgtcatgaaagccgcacaatcgaaccaaaaaccctttgtgctgatgagcctgcgtaatccttacgacgccgcgaattttgaagaagctgaagcccttatcgcagtctacggctttaaaggatatacagacggacaattcctccagccaaacattccggcaggcattgaagcgatattcggacagacaacaccgcaaggcaggctgcccgctgacattccttcagtcacgcatccgggaacgacactgtatccttatggtttcggtatcaatctgaagaccggaaaaccgctttaaacaggagggctgattatgaaaacacatacggctgcacttctcgccggacttgtcgtcatcagtgctatgacggcagtctcggcggcttctgacagaaaccttcataccgccaagaaaccaagcatccaaacaggcatcgaccgcctgctgaaagattataaacaggaactgaagggaaaaagggtcgggctgatcaccaacccgaccggtgtgaacgcatcattgaaaagcagcgttgacgtgctgtatgaggcgccagacatccgcctgacggcattattcggaccggagcacggtgtccgcggcgatgctcaggccggagacaaagtcacatcctatatagacgaaaaaacagggcttcccgtctacagcctatacggggagacgaggaaaccgacgcctgacatgctgaaagatacagatgtgctgattttcgatattcaggatgtcggaacccggtactacacctacatttatacaatggcctatgccatggaagcggccaaagaaaaaggcattcctttttatgtcttggaccggccgaatccgcaaggcggacgaaatccggacggcccggttcttgaaccggattacgcttcatttgtcggactgtatccgatcccgctgaagcacggcatgacgatcggtgagcttgctcttttattcaataaagagtttcatattggcgctgacctcaccgtcgtaaaaatgaagcgctggaagcggacgatgacgattgaagataccggtctgccgttcgtcctcccttcgcctaatatcccgaccccggacagcatatttgcatattcggcaacaggactaatcgaaggcacaaacgtatccgaaggaaggggcacgacaaagccgtttgaacttatcggcgcgccttatatgaaaagcaccgagctcgaagaacgcctgaacagtctcaagctttcgggcgtcaccttcagagccgcttcattcatccccagcttctccaaacaccagggcaagctgtgccacggcgtacaagtctacgtaacaaacagaaacacatttgaagcggcaaaaacagggctctccattctgaaaaccatgcatgacttatatccgaatgacttttcattcttgccgacaggctcttttgacaagctgatcggtaacggctgggtacgcaaaaaaatagaaaaaggcgcttccattgaagacatcaccggcacatatcaacgccggctggaccaattcaaaactctaagaaaacaatacctcatatactgacaacattcgtgttacacgtgtaacattttgacgcatttcacatttccgctttttataggaaaacattcatttatttggtacaatttaaatgataactgttatcatttaaatgaatgtttcctaaaaggtggtttctcatgaaaaacacattattctttcagcccattgatatcatctccgtgaaaaaaacagccgaccttctgtcagagcatcagctcactgattcccccgtattgatctttcatgtgaaaggcgagggacaaattgatatcggaacagacagctttccgctgcagaaggaaacgctctacatctgtccttgtgatgagacattcaatattgcccctatatcgtcaggcggcatccatttgtatatcgtcagactccgtgttttctcctattcctcagatgatgaagcgatgcttccggataacggggaagacatcttccacggacttcagcaaatgaatttacaaacggttgatcatttgacaagccggcttcaatcactttctgaaaacgtgcgatcggcggatggattgcagaaaatgaaatataccgccgactttcagcagctgatgtacgacctttatgccgcaaaagtatgccatcaaaataatacgaaagcggcgatcgaacagacaaaacaattcatacatgctcagtccgacacaaaaatcacgctcacccagctcgctcatatggcgggaatcagtcccaagcattacagtgaaacctttaaaaaactatacgggcagagcgtaactgaatatatcacagacatccgcataaccaatgcgaaaaaactgatggccaaggcaagctgcaaactgcgggaaatcgctcatcaaatcggctaccaggacgaattttatttcagccgcatctttaaaaaacataccggcagctcacctacaagctacatgaaaaaaaggcgcacaaaaatggccgcgtacggaaaagaaacgatggggcatctgattcctctgcatcacgtgccttacgctgcggcgctgcacccgaaatggacggcctattattacaaacaattctcttccgatattccggtccacctgagcgcttaccgctataatgcaaattgggaagagaacctgcatacgctgtctcaagctgccccggacattattttcagtctcgattctgtcagtgaagaagaaaaacagcgcctgaatgacatcactgaagttttttatcttccggctcaagagaattggagagaccagtttcttcgcacagccgcatatctgaatgaagagcaggaagcgcggcactggcttaaaacttatcaaagtctcacccattcagcgaaagatgctcttaaacatgtgcggcaccagcggttcttatttgtccgtgtatataaagaaaatatgtacatcgcccataacaacagtattgaggaagtcttcttcggtgatttggactttgcctccgcaaaaccggaatcatttgctcctgacgaaaagatttccttggaaatgctggcggattgccaggctgactgcatcatgcttttcacttgtaaagaaccggaaacgcttcgctattttcagcggattcagcagtccgggatatggcagaaccttagtgccgtcagcaataaacgcgtgtttcccatttcatctgacccgtggattgaatattctccaagcggacatcagcggatgatcgagcaaagcatttccattttatccgaagatcgtccatggtaatgccggaaattatccatggtcttatccctattcattctctataattccaattgataatagttatcaattgaacaggaggaacaatagatgaagaaattggcattcgctttcatgattttgcttttggctttcacggccgcggcttgcggaagctcagaaacaactgatacagcaagtaaaggaaaggacgcttcttcagataaaaagaaaatcgaatatctcggaaaaacatatgaagtcaaagcgccgactgacaaaatcgccattacaggcagcgtagaatcaatggaagacgccaaattgcttgacgttcatccggcaggagcaatttctttctccggcaaattcccggaactgtttaaagatattacagataaatccgtatcaacgggggaaaaaatgcagccgaatatggaaaaaattcttgagctgcagccggacgtcattctggcatcaaccaaattcccggaaaaaacgttgaaaaaattgagcggcaccgctgaaacgatccctgtctctcatatctcatcaaactggaaagaaaacatgatgctgctcgcccagcttacagataaagagaaaaaagcgaaaaaaatcatcgcagattacgaacaggacctgaaaaagacaaaaacaaagatcaacagcaaagcgaaacagtcaaacgcgctggtcatcagaatcagacaaggcaatatttatatttatcctgaacaagtttatttcaactccacgctttacggtgatttaggcctgaaggcgccggacgaagtcaaagcggcgaaagcgcaggaactgatttctcttgaaaaattaagcgaaatgaaccctgaccatatcttcgtacaattttctgatgacgaaaacgcagataagcctgacgctttgaaagacttagagaaaaatccgatctggaagagcctgaaggcagtcaaaaaagaccatgtatacgtcaatacgattgatccattagcccaaggcggaaccgcgtggagtaaaatcagcttcttacaggttgcggctgacaaattgactcaagactaataaagagtaggtttttcacatgtatgcaaaacggcggacacacattattatcattgcttcaccgattgctattgttctgtcactgctcctttccgttttatacggcgcaaagcagcttgacatccataccgtgttctccgcattgctgcactttaatccggagaataccgaccatcagatcatatggcattcaagaatcccgagggctgccggtgctatgtttatcggcgccgcccttgctgtttccggagcgctcatgcagggaatcacacggaactatctggcctcgccttcgatcatgggtgtgtcggacggctccgcttttatcatcaccctttgcatggtattgctccctcaatcgacatccattgaaatgatcatctactcgtttatcggttccgcattcggcgccgctcttgttttcgggctggcctccattcttcccggcggttttaccccggtgcagcttgccattatcggaacggtgaccagtatgcttctcagcagtctgtcggctgcgctttcgatttattttcaaatttcgcaggatctcagtttttggtacagtgcgagactgcatcaaatgaaccctgattttttgaaactggccgtcccgttttttgcgatcggaatcattacggccatgattctcagcaaaaaggtcactgccgtatcattaggagacgacatttcaaaaagtctgggacagcagaaaagaaccatcaaactcatggcgatggcggctgttgtcatattgaccggaagctcggtggcgctcgccggaaaaattgcctttgtcggtttagtcgttccgcacatcacacgttttctcgtcggatcggactacagcaggctgatcccatgcgcgtgcattatcggcggcgtctttctgaccctttgcgaccttgcgagccgattcatcaattatccgtttgaaacgcctattgaagttgtcacttctatcatcggtgttcctttctttctttatttgattaaaagaaaaggaggggatcagcgtggtgcgtaaaatggcaggaatttatatcattctgattgctctcatattgctcgtaagctatttcagcatgacaagcggttctttttccgcaaagccgggtgaactgctcagtacgcttttccgcatccatccgaatccgcaatatgacattttgctgtttcagctgaggctgccgcgcatagtcatggctgctgccatcggactcggattggggatagccggagctgttattcaggccattaccaaaaacggtcttgccgatcccggtattttgggcattaatgcaggagccggagcgggaatcgtcacgtttatgcttctgtttcagggacaatctgaagcgacggcacttgcctctgcgatgggtatgcctgtcttcggcctcatcggaggactgatggcggccgtgctgatctatattttcgcctggcaccgggggcatctggaatcgggcagaattattctcgtcgggatcgccatgaattccggattcagcgcgctgtctttatttctatcattaaaaatggacccgcaggattatgagatggcgatggtttggaaaaacggcagcatctggtcggcaaactggatgaccattacggcaatccttccgtggctgatcttgttcattcctcttcttatggcgaaaacgtcattgcttgataccattcgtttcgatgaggacacggtgaaaagcctcggtgtttcaaccaataaagaaaaaaccattttgctcattgcctgcatcgctttgatcagcgcatgtgtaaccgcagcgggcagcatggcatttgtcggactgatcgcgccccatatttcccgcaggctcgccgggattgagcacagatactcattaccggtcagcggactggtcggtatgctcctcgtcatatccgccgactttgcgggcaaattgttctttcagccttcagaagtgccggcgggaattatccttgcaattctcggcgttccttatttcttttttcttctgtttaagcaaaaaaaggggatggacgcatgagaggcacccttacagaacacccgataaacggaagggaatgcactgtgtatcttcctccttcctattcggttcaaacaggggctttaccctgtgtgtacgtacttgacgggggttctttgtttttagaacagatagataagcttgaatcccaatttacgaacggaacacttcccgaattgattttcatcggcatcaaaccggctgacagactcgatgagtacacaccgtggcccgcgccttccctgagccctgcgtttcatgatttcggcggcaaagggaggctctttctcgaggagctgacaaatgtcattattcccactgttgaagatacgcatcacatttctgcgcatccggaaacgagaggactgatcggtgcgtcattaggcggactgttttcgatatacgcgatgctgcaaaagcctgaaatattcggcagaatcggctgtatttccggttccttctggtatgaaaaatcagcagattatgtccgctccgcacctttgcggccggcacggcagcgtatctttatgtctgtcggcagccgtgaagcagagcaaaaatgtaacatccaaaacaccatgatcggacaaaataaagacgtgtacaaaagcctgaggcaaaaaggcttttctcaatctcagctctcattcacgatcgaagagggcgccgtgcaccatcaagaagcgttcaaacgacaatttaattcagcactaagctggctgtacggaaaaaaccgctcacgtgactgagcggtttttttcatacttgatcacgaccggcttaagctcaaagcgtctcagcaaatagccgaacaaagcggcaaggatttgctgaaagagcatcccgatgacgaccggaaccgccacttgagacggaaagaaagacacggcgagaacggctccggcgctgatattgcgcatgccccccgtataaatcagagacacgatttcatcctggctccgcttcatcagtcttccgatcagccaagccacggcataacccgtcatggcaataaaaaataccgtgcctgcgatgcccgcaaatttgatatccacgtgcgtgacatacggcgcgatttccgaactgttaatggcaatgacaatcatcagacagatttttgaaaaaggagacagtgaccggcttatcgcctgagtccttaccggcggggaaaactggttgaccatcatccctgcgatggacggaatcaccaccatctccgccagccctttcatcatgccccacacatccatctgaacattcgccccggccaggacagacaggcttaatggtacgataaaaggagaaagtacggtatcaaccaggataatagacagcgtcaatccgacatttcccttatacatcgcagcccaaatcaaactcgtaattccggtcggaatcaccacacccataatcagccccgtcacagttaaagggtcaccgctgaaaatcagatggccgcttccccatgcaaaaacaggcatgaaaatatgcagaacaaacaatgccatgatcatcgggagcggcttctcgatactgcgcttcagcgattgaaaattggcactcagactgcccgtaaatgtaataaatgcaaatatccacggcacagcgccggccatccagctgatatgctgagataacagcacacccgccgccacactagacggagtcaaaagcggcatgattctccccaacacttggttcaacttctgaagccacatcatatgcaagtctcctatatacggttttcaagtctcattcattataacaatgcacaccggcaaatttaaccgaaaaaaagcccggatatattcatccggacttcacaaattctatgccatttgtttcattaaatctcggcttttctgatttaatccctttaattcagcctcaattccgtattctttacatttggcgacaatcttctcaagagcagccgctccagaatcatcccacacgtgggcatcagtcaaatcgatgataatccgtttcacgtcttcatcataaacgatggcattcatcagttcagacacggaagcaaaaaagatctgtcccgttaccttataagttctgacatctttctgttcggaatgtgacacaatcttcagcttagaaattttcgccgtaaaaaagatcgcgcttagcagcacacccgcgaaaacacccttcgataaatcatttgtcagaacgaccgtcacgacggtaatcaccataacgatcgaatcagtaaggggcgctttccgcaaacctttaatcgatgaccagtcgaacgtgccgatggacaccataaccatcacggccacaagcgcagccatcggaattttcacgacgataccgcttaatacggcaattaaaaacattaaaaacgctccggccgtaaaagccgacaaccggccgcgaccgccggctttcgtattaatgacagactggccgatcatggcgcatccggccatgcctccgaaaaacccgttcacaatattggcgatgccttgtccgcggctttctttgttcttatcactatccgtatccgtcatttcgtcaatgatctgggccgtcagcaatgactcaagcaatccgacgaatgcaagcgccagtgaatacgggaaaataatccgcaatgtctcaaacgtccacggaacatccggtatcaagaaatgcggaagtgaacttgtaatcccgcccatatcaccgaccgtgcggacatccgcatggaagaccaccgcaatgatcgtcatgacaataatcgccaccagcggagacggcacagccgtcgtaaccttcggcaaaagatatatgatagccagtgatccgacaagcatggcgtacatgacccatgaagctcctttgaactgcggcagctgcgcagaaaaaatcaagatcgccaaagcattcacaaatccgatcatgaccgaacgcggaataaatttcatcaatttcgctatcttactgacaccaagaataaattgaataatacctgtcaaaatggttgccgcaaacaaatactgcagcccgtaatcagccaccaatgtcaccatgacaaccgccattgaacccgtagcggctgaaatcattcccggtctgccgccgaagatagaaataataatcgcgatacaaaatgatgcataaagcccgaccatcggatcaacacctgcaataattgaaaatccgatcgcctcagggatcagagcgagagcaaccagaataccggccagaatgtctttacggacattcccgaaccattgctgctgtaacgtataatctttcaaatgataacgactccttttcactataaaaatccgcaccttatcagttggaaacattgatttttatctggggaatatgaggcaagcttacggggaaaaggggacacgctcagagtataatgtcttgaggaaaggaatggttaacaaagagtatcatattaaactttaaagaaatgtgcaagaccgtataaaaaagaaaagaaaacggctctcactggagccgtttccgcttttataaaagttccggatcagacacaagaatcgtttttattgcgctgatatcctttctttcttttgtcaccgggtcgatgcccatgagatgatcaatggcttcttcataattcttcagttccgtcttttccgtaataaaatcatagagctgcggaaggtcggatgcacatgctaacgcagcctccatgatctgacgggcttcacctgtgcccacaatcgttacgccgtttgacagcagctgatacggcctgactgtcatctcatacgtatcatcaaagcccatcggcacgattctgcctcccttttcaataaaaggataagcccaatcaagctgattgccgatcgcgtcaaaaattacatcaaattttcttccttgattaatccgtttcacttcatccacggttaatgcttcagggtggtagacataatccgatatccggctcgccgcctcgcttcggaaactgcctatttcagtcgcaaccgtcaatcgcgccagttttttcaccatcatttgcacaagcagtccgattggccccgaccccaaaaccaagaccgagtcctccggctgaatcgaagctttgtccacaacattcagcacacaggagagaggctcaaccaatgtggcccgctcccattccattgaatcgggaattctgtacatgaacctgtcttctccgacgtaatattccgcaaacgttccgtgcgccccgattccgagctgccaatcctcgaaggtttcgcaataacacgtcagccctctccggcaataatgacatttcccgcaaaactgcgtaggatctatcacgacgcggtctccgacttttacatttgtcacgtccggtccgatttccacgaccgctcccaccgattcatgccccataatcatatgatgggttgcattcatttttcctttcagcacatttaaatccgttccgcagataccggtgccgaaaattttcactttcacatcattggatttccgaatttgaggctcgtccacctcttgatattcaagcttatcattaggagtccagaccaacgccttcatatttctcttcctttctgccccagcggatttggtctaacaatgtttgatgaagctccttcgttgatgccgcaatacatgattgctggttctgataacttaaatctgtcagaagcgtttcgtccaaagaccggccgtatgcatccgtaatgaccactcctgctttcttcgccaaaaagacgcttgcggcaatatcataaggaaacaaatgcagcacctctccgtttccgacctgctgaaaatctgaaagcagcttcggatcatctttcagcagacgattgccgatatccacataagcatccatctgccccgtgataattcgtgaaatcgaataagaagcgctgttgaaaacaaaaaccccgccattattggctgaccggtcaatcagatgaccgtatgcatccgtcatcagctgtgccggatgcccgttaaactcaaggctccaaaacatatttttaatatcccgcacttcgctcaaattcggcaattctccctgatacccctcaaactgaatggcgtcgctgtaaatatcaccgtacatgtaagcgcccgatttcaattcaagcaaaaaagcaaattcgatatccttaatctttgcgtttggcttatacgaagcaagcgcaatcgaaatacacgacatttcaagccccgcggcggccggacgcgttccgtctatcggatctacaattaaaatatattgcggatcttctccaatcagcttcaggccgccatcctccgtgtaaaaagcaaccggatggcccttatcttgaatataatccagcaccgcctcctcagcagcggcgtctatgttaaattgggcgtcgcctcccggagaatagccgtttacgagccggtttttcagcgtgcctttttgacttttcaccttatgataaacaaattgtccaagcccgatgatatagtctctcacttgatttcctccaatagcttgcgaagtctgtagcagagcacttctgcttcactaagtgtaatagttaaaggcggtcggattttaaaaacatttccgaacccgtaacgggatgtccggagaatcagcccgtaatccattgcccgttttgcaatataattggtcagctccacatccggttcattgttctcttttacaatctccacaccgatcataagaccgacgcctcttacctcagaaataaaagcgaaatcctctttcatcgtttctaagcgatccataatataatgaccgaccgtcgttacattttccaaaaatcccggacgctgcatgatatctatggttttacacgcggcagcggcggccatcacatttgagccgtacgtgaaggagtgcgtataccccggaagcccggtatacttgtcctccgtcagagtggcggcgacttggaagcctgtgcccccgagcccttttgctaccgtcatcatattaggtttcacatcgaagtggtccgcggcaaacattttgcccgtccgtccgaacccggtctgaatttcatcaaaaatcagggcgatatcgtgttcatcacaaagctgtctcagctgtttaaaatactctttaggcggaacgacgtttccaccgtttccggatatcggttcaataatcatggcggcaatttttccattgctcgcatactcaataaaatcattaattctttctacgcacagcataccgcatgaatcaggtttctgattataaaaacagcggctgcaatacggatcggggacttgaaggccaaaagaaatttgcggcgggaaaggttcttttctgaatgagttgccggacaaagcggaagtcatatacgtttgtccgaggtggcttcgaaataaggagatgacatcggtttttccggagtaatactgagccattttaatagctccttcatttgcaccggaaccgctgctgactttagggtgtacttttgtgagattatcgggggcgatttctactagtttttctgccagtttatttacggcgtctgtttgaaaagatgatgtcacatggatcagcttatcggcttgttctttaaccgtatcaatgacttctttgttaccgtatcctaaattcaagttaaatgtggcagaagcgcaatcaatgtactcattcccctcttgatcgtacaggtaaatcccttctccgcgctccattactacatcgtcaacactgtaatacaagctgtctggattcgtgatttccttcgttcccacaaataccacccctatgaaattattagaatttcgctttttatcgtattaattattgaaaatattgtcaacgatctttcttgtaaaaaatgttaacaatttgttaacgttaccataagggatgtacgagaaaaagttatgtgatatagtaacaatacttggattttttgtaaaaacgtcatgtcatacgagtagagagaaatattattttacgaataaggagataaaatgatgaaatctcgtctgctgtggataagctgtttttcttatggatcgattgcttttacacttgttattctgggagccgtactgcctgagttactcacacattattcacaaagctacagtaatggcggtgtattggtattctctcagttcatgggctttctcatcggtgttattggcatgccatacatggtgaaaaagcttgggcgcaaaaacgtcgttatctttggcctggcactcatcagctgcgaaatgttcatcaccttcctgccgccctggccgctgctctttcttctcgtcagcatcgcggggcttggcgccggattggtggaatcctgtgtaggcacgatcatcctcaccgctattaaagaaagacaggctgtggccatgagcaagatggaagtggcctacggattaggcgcgcttttcatgcctctgctctcaggctttcttatcaacaaccacatgtggacaattgcttttttagtattagggttatccagttttgcacttttaatcgcatggaagcagatgagtttcggcagtattgatcagcttctcatccgaaaagaggtctcttccgatgacactaaaaaagaaagcaccggttatcggtcacacggattgctgtttattgccttggcgggggcttacttcttcttttacggaggcagtgaagtttcaattgtacattttatcccctccattttctctgagaaatgggatatccccaactctttggcaacgataacagttacagtgtattggacggggatgatcatcggaaggttactaacaggcccggtatcagaaaagctgacatatcaccgttatcttcgtctcataagcattggcggtctggcagcacttaccgtattagcactaagtaaaaacgtatggttcggctttgccctttgcttctttttagggctgttcatggcaggcatgtttgcaatagccctaatcatcacgaatcatttttatcccggaaagacagaaacgactaccagtattctgctcgcttcaaacggattaggaggttcactccttccgatcgccgtcggctggagcttagatgaatatcccgcacaaactgcgttctggctgtttactgcactgatggtccttatgctgctgattgtgttcagtttaagaatactcgagacaataaaatcaaacaatcttcaaaatcacaacagcaaagcaaaatcaatgtaaacaaaaaagctaatgcctttgaaaggcattagctttatatatctatgtgatctttcaaataaaaaaaccagttcatcatgaactggtttaagacagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataccacggtgcttctctataaatcaagcattttttttaaaaagagaaaaaaagaaaaccagtatattatctttaaagcttgagaatggtcgggaagacaggattcgaacctgcgaccccatggtcccaaaccatgtgctctaccaagctgagctacttcccgattttaaaaaatattatggcgcgcccgagaggagtcgaacccctaaccttttgatccgtagtcaaacgctctatccaattgagctacgggcgcaatcaatttcacaatatcccgttgggataaaatggagcggaagacgggattcgaacccgcgacccccaccttggcaaggtgatgttctaccactgaactacttccgcaagtaaaagtgtaatacatggccagaatacagcttcagatagcggtaaaccgtattgttatttatactgttcattatgacaaaagtaattatatcaaggttttgataaaagtcaatatcgtttaacaattaattatgttaatctcttttgcatccttgaagaaaggcttcatcaggagacgcgctaaatacctacaccttaactggtacaatcagcaacaggtttttactgaactaaacaaaaaataacagttccataacattcggaaactgcttcagatcaacgtattttagataagcttccaagcgggctcgaaccgctgacctcttccttaccatggaagtgctctacctgctgagctatggaagcaatggctccgcaggtaggactcgaacctacgaccgatcggttaacagccgatagctctaccactgagctactgcggaatattataagcttcataaacaaaaacatggtagataaaataaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataccatgcatcggctgaatttagcaagtatttttttcgtttttttttgaaacgtatttcgttatattcatctccgccgcggcatacgatgtaatcaagcatggacaagataaggaggcgtcaccagtgaaccacttctacgtgtggcacatcagaaggataaaacagctgcttattattatcattgccgcatttgcagcagccagctttttttatatacagagagccgtcccccttcctgtatttttaactgatagcggcccgaaggctatttcaaaaggggagacgaaagcgggcgaagtcgcattaacattcgatatcagctggggcgatgaaaaagcggttccgattctgaacgcgctaaaagcaaacggtattaaaaacgccactttttttctgtcagcttcttgggcggaacggcacccggacacagttgaacgtatggtaaaagacggacatcaaatcggcagcatgggatatgcgtataagaattataccaacctagaggacaacgaaataaaaaaagatatccttcgggcccagaccgcatttaaaaagctgggtgtgaagaatgttcatttactccgcccgccgaccggacaatttaataaaaaggttcttgccattgcacagcagtaccgctattcagtggttcattacagcgttaactcgcaggattggacaaatcccggtcctgataaaatcattgaaaatgtaaacagtcatataaaaggcggcgacattgtcctgctgcacgcctctgattcagcaacacagaccgaagaagcgctccccgccatcattcacaatttaaagcaaaaaggactgaaaaacgtgacagtcggcgacctgatcgcaaatactgacgtcaagtcatcagaagtgaaataactacctctgggcaaacttcggcagcattaacagctgaaacgcattgcagcccatcagcggaatcagcatcaaataaagccagtcctcattattcactcttagcgcaggaacccattcaagcgctgtaataacgaccattaaaaataatgatgaaacgaacgtattttttgaggactgcttttgttttatatacgccgtcagcaagccgacggcaagcagagccagcggcagccagacaaaccccgcaatcgagtcatcccgctcaccgaaaaacaaaaatctgacgtacattaaatcaaaagcgacaaacagaatgataaacagctgaagcagattccaaagcgagtttgatctgaggatttcaagggcaaaccggtgcaccgtcagaaagacgaagaatcccatctggctgatcacactgaaaatcatgcctaccccgataaaccagatcagaacggagaaaatttgaccggcctcaaaattcagaaagaacccttgtactccccccacttcagtgcaaatcccacgacgcttgtaataagagcgcccacagctaaaatcgaaaagaaaaatcgaacaagcccgcggcttttcatctcttattcatccccctgacaatcgcgttcagcgatattttgttatgtataaatccattccgatgaatcatattaaaaataagtacaagtaaggaaggagcttatgcatgtcaaaagccaaaacgctattgataagctgttttgttgtattatctgtaacagcttgtgctccaaaagaccaagcagcggatatggattatgaccagactaaaaaaatggttgttgatatattaaagacagatgatggaaaaaaagcaattaaggaaatattaaatgatgatgcgatgaatgaggcattggtgattgatcaaaatgccattaaaggcacaatagagaaaaccctcacctctaaaaaaggggcggagttctggaaaaccatctttgaagactcaaagttcgccgagagctttgcaaaaacgcttcagcccgagcacgaaaaaatcataaaaaaattgatgaaagaccctgattatcagaaaagttttatgcagatcatgcaggaccccggcatggataaaaaatactatgagctggtgaaaagccaaaagttccgcagttacttagaagatgtaattacagagacactttccagcccgcttttcaaaaagcaattcgaggatgaattgaaaaaagcggcttcaagttctgaaaaagaaagccaataaaaggccgggccgtgttgatcccggccccttttttattcagctgttttttcaatgactttttgggcgatacccatataaatttccccgatcggatgacttctgtcatagacagaaggcgcaaactggtccttgtcccaatcaggctgttttaaaggaattctgccaagcagcggcacctgcaattcctctgcaagcttatctcccccgccttgaccgaacacatattctctctcgccggtttttgcactttcataataagccatattttcaatgacccctacaacttcatgatcggtcttaatcgccatagatcccgctctcgccgctacaaatgcggctgtagggtgcggcgttgatacgataatctctttgcagctcggaagcatcgtgtgtacatcgagcgccacatcacccgtgccgggcggcaggtcgagaacgatatagtcaacctctccccagtcaacctcatggaagaagttattcagcatcttgcccagcatcggccctctccacacaaccggagcgttttcttcgacgaaaaagcccatcgacataacctttactccaaatctttcgacaggaagcagtttttctccttcaactgtcgggcgaactgtaatacccatcatgtccggcacgctgaatccgtatatatccgcgtcgatcaagccgactttttttccgagccgcgcaagagaaatggccaggttgacggaaaccgttgatttgccgacaccgccttttccgcttgccaccgcaagaaagaccggcggatgtttcctattcagcagggtttcgctttcagcagcaggccggctgaatttcgccaatgtttcttccggcagctcttcaaaccgaagtcccacagtttccgcacccgcttctttcagaacggatacgatttcctgctgaatgcccatctgttcagccgtccccgtttttgccaatgcaatttttacactgacatgccgtttttccggcttgacctttacttctttaatggcatccaattctcccagcggtctatgaagaaaaggttcgcgcatgtttccgactatatttcttacttcatcttctcttatcatcgaaccctcaccctttgtgtattcgtttacaaatggtattataccatatattaaacgtagaatcggcgaaaaaccctccttactcgggagggtctcctttttctgtaaaatatctcaacacgcccttatacacggaagaagcgattttgtcctgatatttaggctggccaagccttttcgcttccgcgggattggacagaaatccgatttccaccagggcgcccggtttggttacattctgcattaagtaaatgccgtgtatccgtttcgcctttctcgttgtattctccaaattgattctcaattcgtcctgtatatattttgccactttttcattctcttcgtattttccatagtagaagctttgggcgccgctccatctcggtgacggtatggcgttcagatgaatgctgatataaagctccgcctctgaacggttgatgatctccacgcgctttctcagatcttccgctttgcgtctgctgtagcctttcgtcccttcaggagctaaatcagtatccgtctcccgcgtcataatgaccaaagctccctgctcctgcaaatagtctctgaccctggaggccacttcgagagtaatgtccttttcaaggtgactgcctcccgtggcgcctccgtccggcccgccgtgtcccggatcgagatagatgattttcccgctcagcggcaggctccacggccgccatgaatcatcattatggaattgaaaccggaataaacacaataatatgataaagccaagtaaaaaaccgagccatttcagcttttttgtcatagctttccctcccgcttgtccccgttattaataagtatgggacaagggaagaaattatgattacctcatgcggagcttacattgtttttctctttgcagaaatccttccgtccaccagctgttgataaaccggcaggacgcttcatagatttctttttgttcaacggaagaatattgctcatgcgtccaattgcaaagatattcaaaaaaatcggccgtcagttcttcctcttcttcagccgaacgggcgttcgccctctgcaaagactcaccataaaatccaaagacgccgaaccggccgcctaataaatacgcttcaattgcaaaatctatgcatccttcactcagaatgccgttttcgtcttgaagaaagggaaacaaaggggtgagacatgcttttacggactgaatgatctgcgtcagtgacagctcctttagtaaactcttctcaagctcataatccttctgccgtttcacgtctgaaaaagataatacttctgccattgccagccacgctcctttttactgttattttgaaaggaaaagggaaaaagcatgctttgttgatagtggaaatcctcccaaatgaaggagtttcatgttaactggaagaataaagagctgaggtgacgtgatgaaaaagctgtttcaatacaattggacggtgcgtgacgagtggtttatgatatgtgaaaagctgagccgggaggaactgacgaaaacccggacgggcggaatggagagcatcttgcggactttatttcatatcattgatgtcgagatcagctgggctcgtgccattttaggtaaagatgatgttttacccgctgagtctgactatacgagcattcaggatctcagaaagctgtctgaacagtatcgggaggatgtcattcatgcggtctcccgcaaaggggcggatcttgttaagccggactggatggaccaaacctttcctaaagaagatattctccgccacatccttgcgcatgagattcaccacatgggacaactgtcggtttgggccagagagattggaatagaaccggtttcggctaatgtgatcagccgtccgcaggaaaaagccgcaaaaaaacagcacctctgacgggatgccgtttttatattttaatgcttcttgttacggagtatgtattaatgtattcatccagcacgaggccgcctttgtcctcgtaaaaaccggcaaccataaagcctgcgtcaatctgacctttaatttgatcctccagcgtatggccgaattcaagcgcttcatgattatcaataagttcctttacctttttcttactcagatctttttcatccgaaaacggaatggaatactttacttttagtacgccttcctgctctaaatccatatcaaataagaacacgacgggatttacaaaaccggagactaaagacccgccttttttcaatacgcgataagcttctttccataccggaagaaccgtatcaacaaagcaattcgataccgggtgcacgataaaatcaaatgtctcatcatcaaaacagctcagatcattcatgctgcctttgacagtccgaagcgtaagaccgtcccgctgggcaaccattctgtcttgcgcaagctgtttttccgaattgtcaaagatggtgacgtccgctcctgcagcagcaaggaccggcccttgctgtcctcctcctgaagcgagacaaagaacctccagaccgtctatgggcggaaaccaatccgccggcacatcttttccgggggtcattctgatgctccaattgccttttttcgcttcaccaattgtatgagaatcaaccgcaaccgtccattcattgcctgtttcgacttttttatcccatgccttgctgttatgtatgactaacttattcattataactgcgctccttattggtaatgaatagagtataacaaacaattctagaaaaacatcggataacctcttcgatatgagaaaaaaatacaaaaaaaccacaaccaagaagttgtggtttttgccatccaaaacgattaacgttttgagaactgaggtgcacgacgagcgcctttaagaccgtattttttacgttctttcatacgggcgtcacgagtcagaagaccagcacgtttaagtgttgcgcggtattctggatctgcttcaagcaaagcacgagcgataccgtgacggattgctccagcttgaccagataagccgcctccatgtacgtttactaaaacatcataagtaccagctgtttcagttaaagttaatggttgtttgatatcttcgattagagccggagatggaatgtgctcgctgatttcacgattattaacgacgatacgaccttctcctggaactaagcgcacacgcgctacagaacttttacgacggccagtaccgtaatattgaacctgtgccaaattggtaacctcctttttaattaaccgcgaagttcgtaaacttcaggtttttgtgcttcatgtggatgctcagaaccacggtatacgttcaatttcttgaacatttgacgacctagagaaccttttggaagcatgcctttgatagcaagctcaagcattttctcagggtagtttgtacgcatttcaagagctgttcttgatttcagaccgcctgggtgcattgtgtgacggtagtagattttatcagttaactttttaccagttaactcgattttttcagcgttgatgatgatcacatgatctccagtatcaacgtgcggtgtgtaagtcggtttgtgtttcccgcgaaggatagatgcaacttctgtagaaagacgtcctaaagtcttgcctgctgcatcaacaactaaccacttgcgttcaatagtacttgcgttagccataggtgttgtacgcatttaattccctcctaaatgatctgtcattttttcataaacttctgttacgttctatttcacaacacaataagttccggggcttatcgtggggttgaaatacataccatatgatatcttataactttatgcagactctgtcaagaaaatgttacacctggtttagttgtcatagcaaacgctccataaatacagcccgtgccccggtgcggtgcgccccgcggcttcgcgatccttcgcttcgagcattgcttttacatcatcgggagaaaattttccagctcctgtatccaataacgttccggcaatgattctgaccatattatagagaaaaccgtttccggtgatccgcatctgcaggccgtctccggtctcagtccaatccagctcgtaaatcgttctgaccttatcctgaaccgcggtatcagccgcgcaaaagcttgtgaaatcatgtgtcccgatgaggtgccttgaagcttccctcattttctgcacattaagctgatatgcaaaatggtaagcgtaatgtcgtttaaatacgtccgggtgtttctccgtatatacaaagtagcgatattccttttggactgcgctaaatcgtgcatggaacccatcatccgcaatctctgctgttttgacggcaatatcatcaggcagcagggcattgagcgcaaacggccatttctcagccgggatggacagcggcgtatcaaaatgaataacctgcccggcagcatgaacatcgctgtccgtgcggcccgatgagatgacaggcaccctgccgtccgttttatggatgacggccagcgctttttccaattcactttgaacggtccgctttccaggctgaacctgatatccgttaaataaatgcccgtcataagcaatggtacatttcactctcattcagcagcacctctaacttcttaagaaaaacaataacacggctaatacgatgatgagcagaatggctccggtatcctttccggtccagacgagctttctgtatttcgttctcccctcaccgccctggtagcctctcgcctccatggcgaccgcaagctcttccgcgcgtttaaaggcgctgacaaacagcgggacaagcagcggaacaaccgctttgattctgtctttcaccgggccgcttgtaaagtccgcacccctcgccatttgcgccttcatgattttatctgtctcttccatcaatgtcgggataaatcgcaatgatatcgacatcatcaatgcgagttcgtgtacgggcagcttcacctttttaaaaggattcaagagctgctccattccatccgtgatttcaatcggcgttgttgtcagcgtcagcagcgttgtcataaagataaggtaaacgaaacggagggagataaaaatcccctgtataagtccgccctcatacactttaaaccagccaagctgaaaaatgacagatccttcatgcgtcatgaaaatgtgtaataaaaaggtaaacgccacaatccagataatcggcttaagccctttcagcaaaaagctgaacggcactcgtgttaaggcgatcaccccgaatgtaaacaaaccgagcaaagcatacgtttgtacgttgtttgccaaaaaaacgatacatacaaaaagaaagatgctgacaagttttgttcgcgggtccaatcggtgaataagcgatgatccgggaacatactttccgataatcatgctgtccatcattggtccttttcctcctgaaagaaagccttaatttcgctcgcggcatcctgcagggtcagcatgggtttttcatacttaactccgagagcctcctcaagccgtctctgaaacttcaccgactcaggaagatccagtcccatttcggccatctcttcaccttttacaaacaagtcacgcggactccccgtcgctttaatggtgcctttgtgcatgacgatcatttcgtcagcatagcgggcggcgtcctccatgctgtgggtgacgagaacggtagtcaggtttccccgctgatgaagcgcatagaacatgtccataatgtcctggcgccctctcggatcaagaccggctgtcggttcatccaaaaccagcacttccggctccatcgcgagaacgccggcaatcgccactctgcgcatctggccgccgctgagctcaaacggtgaacgatccaaaatgtcttccggaaggcccacaagccccagcatttcttttgctttccgttcagcgtcttctttttttacaccgaaattcatcggtccgaatgcgatgtccttcagcacagtctcttcaaacagctgatgttcgggaaattggaaaacgattccgactttttttcgcagagtcttaaggtctttattctttttaccggctgccagaatcgtgctcccgagctcaagctgtcctttagtcggtttcagcaaaccgtttaaatgctgcaggagcgtcgatttgcccgaccctgtatgtccgatgacggcaacgtagctgccctcttttatcacggcattgatatcatacagagcaagccgttcaaacggtgtcttcatttgatagcggtgttctacatctttgattttaatgtccacagctcattcaccagcccttcctgagtcagatggtttttcgttaacgccagtccgctttctttcaaaagcaggctgagctggaatgagaaaggcaaatcaagaccgatgcgaaccaagtcttcatttaatttaaaaatctcttcaggcgtgccctctgcatatttcctgccgccgttcatcacaatgatcctatccgcccttgcggcttcttccaggtcatgtgttatcgaaatgacggtggccatgccctgatcttttaagcgtctgacagtatcaaggacttcttctctcccaatcgggtcaagcatggatgtcgcttcatccaaaatcataatatcaggacgcgcggcaataattcccgcgatcgccactctttgtttttgacctccggagagatggtgcggctcttgatcaagaaaatcctgcatattgacttgtgtgacagcccaatctactctctcaatcatttcttcgcgcggaacaccattgttttctaaaccaaaagccacatcatcgcgaacagtcgttccgacaaattggttatcgggattctgaaagaccatccctattttttttcgcacatcccacacggtatcctcagtcagcttgatgccgccgacttcaatttctccggcctcaggcaaaatcagcccgttcagcgctctggccaaagtcgacttccctgaaccgttgtgacctacgatagcaagccattctccttcatatacctccagactcacaccgtccagcgccggtcttactgcatctttgcggtagcggaatagaatgtcttttacggatataagctgtttttgatccacgggcgcctgacctcctctcagctatagctctgcttttctgtctcatgataaaaagttctgatatctaaaaaaagggcatagatccagttagaaactgtcccgcccttctttagatacacaaaaatatgtgattaaaccaattcgatgattgccattggtgcaccgtcaccacggcgaggaccaagcttcataatacgtgtgtatccgccttggcgctcctcgtaacgagttgcaatgtcagagaataatttttgaagtgcatcttggttattttcttcattagcaacctcgttgcgaatgtatgcagcagcttgacgacgagcatgcaagtcaccgcgcttaccaagagtgatcatcttttcaacaacagagcgaagttctttcgcacgtgtttcagttgtttcaattctttcgttgatgatcaaatctgttgtaagatcacgaagcatagctttacgctgtgaactcgtacgtcctagttttctgtatgacatgtgatgtcccctcctttaatggaatgctgtttctaattaaaaaacacacgaaaatcctagttcacatggaaactagatcaatcgtctttgcgaaggccgagtccaagttcttcaagtttcgctttcacttcttcaagtgatttgcgtcccaggttgcgaactttcatcatatcttcttccgtcttgttcgcaagttcttgaaccgtgttaatgcccgcacgcttcaagcagttgtaagaacggacagaaagatcaagttcctcaatcgtcatttcaagaactttttctttttgatcctcttctttttcaaccatgatttcagcatgctgagcttcgtcagttaaaccgacgaatatattaaggtgttcagttaaaatctttgaaccgagagcaattgcttccttcggtccagtgcttccgtcagtccaaacatcaagtgtaagtttgtcatagtttgcaacctggcctacacgagtgttttctacctgataagataaacgagaaactggcgtaaagattgaatcgatcggaatcacgccgattggctgatcgtctcttttgttcgaatcagcaggtgtatacccacgtcctctttgtgcagtaaggcgaactcggaaactcgcattctcaccaagagtcgcgatatgaagatccggattaaggatttcaacatcgctgtcgtgtgtaatatcagctgctgtgacagttccttcgccctgtacatcaatttcaagcgtcttctcttcatcagagtagattttcaatgcaagctttttaatgtgcaagattatcgttgtaacatcttccacaacgccttcgattgtcgagaattcgtgcagtacaccatctatctggatcgatgttacagcggcaccagggagtgaggataagaggatacgacgtaaggagttacccagagttgtaccatatccacgctcaagcggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccattatgaggaacaggagttacgtctctgatagctgtaacttcaagtccggcagcttgtaaagcacggattgcagcttcacggccagaacctggtcctttaacagttacttcaagagttttaagtccgtgttcgattgaacctttagcagctgtttcagcagccatttgcgcagcaaaaggagtcgatttacgagaacctctgaatcctagagctccggcacttgaccaagaaatagcattaccatgagtatcagtgatcgtaacgatcgtgttgttgaaagttgaacgaatatgagcgattcctgactcaatattctttttcacgcgacgtttacgcgtgttttgtttacgagcagcagccattgtttaggtacctcccttacttattttttcttgttagctacagtacgacgcggacctttacgagtacgcgcattgtttttagagttttgtccgcgaacaggcaaacctctgcgatggcggattccgcggtagcttccgatttcgatcagacgcttgatgttaagagaaacttcacggcgaaggtcaccttctactttcagtttgtcaataacatcacggattttaccaagttcttcttcagtaagatcacgcacacgagtatcttcagaaacaccagcctctttcaagacttgctgagccgttgtgcggccaattccgaagacatatgttaaagaaataacaacacgtttgtcacgtgggatatctacaccagcaatacgagccattctctgggcacctccttattaattatccttgtttttgtttatgctttggattttcacagatcaccattacttttccttttctgcgaataactttacatttctcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacgtgagccaaaaccgtatggccattttcgagttcaactttgaacatcgcgtttggcagtgtttcgacaatcgtaccttccacttcaattacatcgtctttcgccattcaagtgttctcccttcttcaaatcagtaacttgctctctgacaaatttcaaaagagaaaatctcagttatccgtttgtcacacgccctgtttcgtttatactgttctgaacttccggagatacgcaatcataaagggtgaatgattgatattctttttctaaggagaatgaaatgtacgcttttctccgtctgctttagtacacgatgatgaatcttccttccgatgacagcagctagccggtttttcttccgaccaattgtaaacctacaatctgcccaggtgcggaatgaaaaacatgtgtcatggaattcatttcatcatctagacttttgtcagtatatcaaaacccgtttccgtaatcgcaatcgtatgttcaaaatgagcacactttttcccatctaccgttacaaccgtccagttatcagccaatgttttcacataccggctgccagcgttaaccatcggttctatagcgagaaccataccaggcttcagcctaggtcctttgtttggcggaccgtaatgaggaatttgcggatcctcatgcaagtcttgaccaacaccatgtccgacatactccctaacaactgaaaactgctcattttcgacatacgtttgtattgcgtgggaaatattcgacaaacgttcacctggttttgcttccttcaagcctttatataaagactcctctgtcacttccagcagtcgtttatcatcatcactgatgtttcctaccggatatgtccaagcagagtcaccatgataaccatttaatttagcaccgatatcaatgctgataatgtcaccgtcacgcaaaacccttttaccgggaattccgtgaacgagttcttcattaactgatacacagatgctcccgcgaaacccattataccccttaaaagatgggattgcaccctgcttctcaataaaacgttcggcaatttgatccaattcttttgtcgagattcctggtttaatgtgctttttcatctcttcatgagtcaaagccacgattcgccctgcttcccgcatgatgctaagctcacgaggggtcttacagataatcatttgctcaatcctccaagaagctctttcacatctttgtacacgtcgttaatgtcctgctggccattgacgttgacaagataccctttctcagaataaaaatcgagtaaaggctgagtctgcttcatgttgacctcaagccgttttgagacggtttcctcattatcatctgcccgttgataaaggtctcctccgtctttatcacaaacacccggcgttttcggcggattgaaaaccaaatgataggttgtgccgcaaacactgcaaattctgcgtccagtcaaacgttccattaaagagtctttgtctactttaatgttaatgacataatcaatcggcttgccgtattcctcaagaatgttttcaagagcttcagcctgagcgactgttcgcggaaatccgtccagaagaaaacctctttcacaatcatctttgccgagtctttctttgacaatgccgattgtgacttcgtccggtacgagctcgcctttatcaatataagactttgcttcgagtccgagtggtgtttcttctttcatagcagcacggaacatatctcccgttgagatatgaggtatcccataatcctcaacaattcgttctccctgtgtgcctttaccggctccaggaagtcccattaagactaagttcattcggatttcccccgtcctctcttatttagaggaatggttaaaaccagtcctctaatttttcataaatcctcggtaattacgtttcactaactggctctccagctgcttcattgtctccaaggctaccccgacgacaattaacaatgatgttccgccaatctgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgtttttttaggttatcagccatttgttcagggtttacctgcacaaaagcatagaagtacgtaaaggcgataattaatgcgacataaaccgtcatgcccaccggatgtgtattgtcaaagttggcttgaatccactttgtcacatcgttttctccgaaaaatgacgcgatagtacgcggcgtaataaggaacgcaaccgcaaagattaccggaataacccctgccggattcactttaagcggaaggtgagttgactggcctccgccaacaggtgaacgaccttgcccttttgcatattgaatcgcgattttgcgtacagcctgctgaatgaaaataacaccaacaataacggctaaaatcgcaatcaccagtaaagcgattttcacaatatgaataaacagctgatcgctgctgccgacaaattgagtctcataaatctgcccaacagttttcggaatactagccacaatccccgcgaagatgatgatcgaaattccgttacctactccattggaagtaatttgttctcccagccacattaaaaaagcagttcctccagtgagtactaaagcaataatcagatatgtcgatatgccggatttttcaatcagcataccgtttgccaggttgttaaacccgtaagacatacctaatgcctggataaaaccaagcacaatcgtaaaatatctcgtgaactgagctaatttacggcggccgacttcaccttgcttagaccactcggtaaacttcggcacaacatccatctgaagcagctgaatgatgatcgaagcagtgatgtaaggcgtaattcccatcgcaaaaatggagaactgataaagcgcaccgccgccaaatgtgttaaggagatcaaaaacccccatcgaactttgtgtctgcaacgcctgagcatttacatatggcacagggataaacgcacctatgcgaaagacgataagcatgagtaatgtaaaaatgattttattccgaatatcactcacacgcataaagttggagattgtcttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctcaagaagaagttcaggagtgacttccgttccttccgcaaaaccgttcaatttgtctacgttcacaatagcgtattccttacggttgatgtttgtaaaaccgcgcttaggaagacgttggaataaaggcatttgtccccctcgaatccagggcgtacaccgccgccagaacgagcgttttgacctttgtgacctttaccagctgttttaccgttaccagaaccaataccacgacctacgcgattgcgtactttacgtgaaccttctgaaggctttaattcatgaagtttcattaggacacctccttagcctataatttatttttattgttctttaacagaaactagatgagatactttattaatcataccgcggatcgcagcgttatcttcatgaacgacagtttggtttgttttctttaaaccaagtgttcttacagtaacgcgctgatcttccgggcgaccgattacactgcgtttgagggtaatttctaatttagccattaatgttccctccttatcctaacagttcttctacagattttccacgaagcttcgcaacctcttcggcacgtttaagctcacttaaaccttgaagtgttgcacggatcatgttgatcggtgtgttagaacctaaagacttagaaaggatatcagcaacgccagcaagctcaagtaccgcacgtacagggcctccagcgataactccagtaccttcagaagcaggtttcaacaagatattgcctgcaccgaaacgtccgatgatttcgtgtggaatcgtagttccaaccattggtacttcaatcaaattctttttcgcatcttcaacagctttgcggattgcttcaggtacttcttgtgctttaccagtaccgaaacctacgtgaccgtttttgtcaccgacaacgactagagctgcgaaacggaaacgacgaccacctttaacaactttcgctacgcggttaaccgtaactaagcgttcttctaactctaatttgcttgggtcaatacgacgcataatcatgtgtccctcctttttttattaaaatttcagtccggcttcacgagctgcatcggccagagcttttacacgtccatggtataagtatccgccgcggtcaaatactacgtcagaaacacctttctcagaagcgcgtttcgcaacgagttcaccgactttagcagcagcagcgctgtcaccagtgctttccacgttcaaatctttatcaagagtagaggcactagcaagtgtaacgccatttacatcatcgatgatttgagcataaatgtgtttgtttgaacggaacacattcagacgaggtctttcagctgtgcctgaaagtttagcacgaacacgggcatgtcttttttgacgagcagcatttttgctagttttcgtaatcatccttaggtcactcctttcttcactttaagcggtcttacttagcagatttaccttctttacggcgaacaacttcaccttcgtagcggattcctttacctttgtaaggctctggagaacgtacagcgcggatgttagcagcgatagctcctacacgctctttgtctgtaccttttacaactactttagtttgagaaggaacttcgatttcgatgccctcttcaggaacgatctcaacagggtgagagtatccaacgtttaaaacaagtttgtttccggatttagccgcacgataaccgacaccgactaattccaaacctctttcaaatcctttagatacgccttcaaccatgtttccaagcagactgcgagtcgtaccatgcagcgcacggtgctctttgtgatcagaaggacgagtaactgtaagcacgttgtcctcaattttgatttccatatcaggatggaaagtacgagttaattctccttttggtccttttacagctacagtgttgccttcgttcagcgttactgtaactccagaagggatctcaagcagttttttacctacacgagacatactaaaacacctccattcttgttaaacttcttaccaaacgtatgctagaacttctccaccagcttgttttgcacgggcttctttgtccgttaaaacaccttgtgatgtagaaataatcgcgattccaagaccgttaagtacgcgaggtacttcatttgatttagcgtatacacgcaaacctggtttgctgattcttttaagaccagtgataacgcgctcgttgttttgtccgtatttcaagaaaacgcggatgataccttgtttgctgtcttctacgaactcaacgtcacgaatgaaaccttcacgctttaaaatgtcagcaatttctcttttcaatttagaagcaggaatttcaagcttctcatgacgtaccatgtttgcattgcgaatacgagtcagcatatctgcaattggatctgtcataaccattatataattacctccttcccattcttggggattaccagctggcttttttcacgccaggaatttgtcctttatatgcaagctcacggaaacaaatacggcaaagtttaaatttacgaatgactgagtgcggacgtccgcagcgttcacagcgagtgtactcttgcactttaaactttggtgtacgttgttgtttcgcaatcattgactttttagccacgatttcgcctccctttcattgattatttctggaacggcatacctacttgagttaatagctcacgagcctcttcgtcagagttagcagtcgttacgataacgatgtccattccgcgaacctttgttactttatcgtagtcaatttcagggaagattaactgttctttgataccaagagtgtagtttccgcgaccgtcgaaagatttcttagaaatcccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgcttttgcgttttgaacagcatcaccgacacccatgttgattacgattttttcgatttttggcacctgcataacagagtcgtagttgaacttcgtcattaaagcaggtgaaatttctttattgtacttttctttaaggcggttcatgagatagacctcccttcctttaaatactatttatctaagacttgcccagatttttttgcaacacgaacttttttgccatcttccactttgtatcctacgcgagtcacttcaccagttttaggatcgagcggcataacgtttgatacatgaattggcgcctcttgattagaaataccgccttgagggtttgcttgagttggtttagagtgcttcttcaccatgtttacgccctcaactagaacgcggtcctttttagggaaagcagcaaggatcgtaccttgtttgcctttatctttaccagagataaccattactttatcgccttttttcacatgcatcctgatcgcacctccttgagtaaggcatttatttcattagataacttctggagccagagaaacaattttcatgaagttgttttcacgtaattcacgggcaaccggtccgaagatacgagttccacgcgggctcttgtcgtcacggatgataacacatgcattctcatcgaagctgatgtatgatccgtcagatctgcgtgctccgctttttgtgcgaacgataacagctcttacgacttcaccttttttgacaacgcctcctggtgttgcttgtttaaccgtgcaaacaattacatcaccaatgttagccgttttacgtccagaaccgccaagaactttaatagtaagtacctcacgcgcaccggagttgtcagcaacttttaaacgagtctcttgttgaatcattatttgttacctcccttcggaaaaagaattccgaactttattagataataacagcttcttcgacaacttctactagacgaaaacgcttagttgcagataatggacgagtttccatgatctttacgatgtctccgattttagcttggttattttcatcatgtgctttgaatttctttgagtattttacgcgtttaccgtaaataggatcctttttgtatgtttcaacaacaacagtgatggttttatccattttgtcagaaacaacacggccttggtaaactttgcgttggttacgttcgctcatgctcacgacctcccctcagtgattatttgttggcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacggagagcttcacgagctacctcttcagacacaccagaaatttcaaataaaactttgcccggttttacaacagctacccagccttcaggagcccctttaccggaacccatccgtacctcaagcggtttagcagtgtaaggttttgaagggaaaattttaatccaaactttaccgccacgtttcatgtaacgagtcatcgcaatacgtgcagcttcgatttggcggttcgtgatccaagaagcttcaagagcctggataccgtactcaccaaaatgtacttcagtaccgcctttagcgcgaccgcgcatttttccgcgatgctctctgcgatatttaacgcgttttggtaataacatattattttcctccttcctcagttttcttcttagtaggaagaacctctccacgatagatccagacttttacaccaagcttaccgtaagttgtgtcagcttcagatgttgcatagtcgatgtcagcacgtaaagtgtgcaatggaacagttccttcactgtagtattcagaacgagcgatatcagctccgccaagacggccggaaaccattgttttcacaccttgtgctccagcacgcatagtgcgttggatttgttgtttctgcgcacggcggaaagaaatacggttttctagttgacgagcgatgttgtcagctacaagctgagcatcaagatctgctcttttgatttcaagaatgttaatgtgtacacgcttgccagtaaggctgttaagggctttacgaagtgcttcaacttcagatccgcctttaccgattaccataccaggcttagcagtgtggatcgtaatgttaacgcggtttgctgcacgctcgatttctactttagaaacagaagcgtcagaaaggcgtttgctaatgaattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgcgggcggaatctttttaacgttgggccttcgtcaacaaatgcctgagaaataaccagattgttagcgtccatctcgtagttgtgctcagcatttgcgatagcagattttaaaactttttcgatgatcggagaagcagctctcggagttaggttcaagatagatactgcttcgcctacttgcttacctcgaatcaggtccattactagacgtgctttacgaggagcaatacggactgttcttgcaacagctttagcttgcatttaaaagcctcctctcttagcgtcttgtttttttatcgtcactggcgtggcctttgtaagtacgagtcggtgcgaattcgcccaacttgtggcctaccatgtcttcagaaatgaatacaggcacgtgtttacgtccgtcatatactgcgatagtgtgaccgataaattgtgggaaaatagttgaacggcgagaccaagtttttacaacttgtttcttgtccgtttcatttaatttctcgatttttgtcatcaagtgtccatcgacaaatggtccttttttcaagctgcgagccattttggaacctcccttcgtgattgcactacggtccgaaatgaaccgtagacaaccccgttatttatttttacgacgacgtacgataaatttatcagatttgttctttttcttacgtgtcttgaatccaagagtcggtttgccccaaggagacattggtgatttacgtccgattggcgcgcgaccttcaccaccaccgtgcgggtgatcgttagggttcattacagaaccgcggactgtagggcggatgcctttccagcgagagcgtcctgctttaccaacgttgataagttcgtgctgctcgttacctacttgaccgatagaagcgcggcaagcagaaaggatcatgcgaacttcaccagagttaagacgtacaagaacgtatttgccttctttaccaagaacctgagcagatgtaccagctgaacgtacaagctgtccgcctttaccaggttttaattcaatgttatgcacaactgtaccaacagggatgttgataagcggaagtgcgttacctactttgatgtcagcttcagggccggacatgatttcagtacctacttgaattccttttggagcaagaatgtaacgtttttctccgtctacatagttgattagtgcaatgttagctgaacggtttggatcgtactcaactgtagcaacgcgtccaggtataccatctttatcgcgtttgaagtcgataacacggtattggcgtttgtgtccgccaccttggtgacgtacagtcaatttaccttggttgttacgtccgccttttttgtgaaggggcgcaagcaaggatttttccggctggtcagtcgtgatttcagcaaaatctgaagttgtcatgccacgacgtccgttagaggtcggtttatactttttaatcgccattttgaatttccctccttctttttacagataattaagcttcaaaaatttcgatttctttgctgtctgcagtaagttttacgatcgcttttctgcgacggctagtcataccagtatagcggccgacacgttttgatttccctttgtagttcatgatgttgactttgtcaactttcactccaaagatactttcaactgcatctttcacttctgttttattagctcttacatcaacttcaaaagtatatttcttttcagtcattaaatcagcagaacgttcagtaatgacggggcgcttaagaacatcacgaggatctttcattatgcaagcacctcctctactttttcaaccgcagcttttgtaatcagaagcttctcgtggttgacaacgtctaacacgttgattccgttagcttgaacaactgtaactccagggatgttgcgtgcagaaagagatactgcttcgtttgcatccgcagttacgattaaagcttttttctcaacagataatcctttaaggacagctgccatttcttttgttttaaccgtatcaagagtaagatcttcaagaacaataatgttgttgtcgttcactttagaagacaatactgatttgattgccaagcggcgaacttttttaggtaatttgtaagaatagctgcgtggtgttgggccgaatacgacaccacctccgcgccattgcggtgaacggattgaaccttgacgggcacgacctgtacctttttgacgccatggtttgcgacctccgccgcgtacttcagaacgattttttactttgtgagatccttgacgtaaggaagctctttgcataagaatagcgtcgaatactacgctctcatttggctcaattccaaatacagaagcgtttaattcgatatcaccagcagtagaaccgttttggttgtataatgctacttttggcatgatcaatttcctcctttcctaagagacttatttagatttaacagcacttttaacagtgattaaagcttttctcgcaccaggtacgttacctttaatcaaaagaagattgcgctcagcatctacttttacgacttcaaggttttggacagtgatttgatctccgcccatgcgtccaggtaatagtttacctttgaatacacggttaggatctacaggtcccattgaaccaggacgacggtggtagcgtgaaccgtgagacataggtccgcgagattgtccgtggcgcttgattgcaccttggaaacctttacctttagatactcctgttacatctacgatttctcctgcagagaaaatttcaaccttgacttcctgaccaatttcatacgcatccatatccacgccgcgtaattctttaacgaagcgcttaggagcagtttccgcttttgcaacgtgtcctttttccggtttgtttgaaagcttttcgcgcttatcgtcaaaaccaagctggatcgcttcatagccatcattttcagctgttttcttttgaagaacaacgtttggagctgcttcaataacagttaccgggataagatcaccgttctctgcgaatacttgcgtcataccaatttttcttcctaagattcctttggtcattcgtcacacctcctattaagatcattctatattttagaattaaagtttgatttcgatatcgacaccagatggtaagtctaatcgcatgagagcatcaacagtttgtggtgttgggttcacaatgtcgattaaacgtttatgtgtacgcatttcaaattgctcacgagaatctttgtatttgtgcaccgcacgaaggattgtgtaaactgatttttcagtcggcaacggaatcggaccagatacgctggcaccagaacgttttgccgtttcaacaatcttctctgcagattgatcaaggattctatgatcatatgcttttaaacgaatacgaattttttgttttgccattattttccctccttttcgcctacatcacgttagacagttctccgtgagaaaaacctgatcaccttgccatggcaaagcggccgggtgtgtcagcaacctctcacttcatcgcagtcaaagaccaacatacactattatacagaaaatagacgcatgttgcaaggtttatttaaagaaccttgtggttttcacactttgattattatacaggtgataccatgattaatcaaggatatgactgttttctttcagagatggaacgatgcgaaccggctgacaacttcggcaaagcgatccggttcctccaagtgaggcgaatgggctgagttctcaaaccaatgccattctttatacggcgcatcaaccttctgataatattcataagacgtcgtccccggaaccgtcaaatcgtatctccctgacataaaacagcacggtattacaatagaagaaactgattcccctgcatcaaaggaaatgagatcctcccacaggtgtttcaggctgaacatttgtccccgcgcggctaagaagctccctctcacaccgtacggttcaccaaacagcattcgcccccctgctttaagagcgccgatcggatgatgggtaaagccccctcccctcatttcaatacaaagcagaaacagcgttcgctgcagctgtttctcccatgggggtgctccgataaagctcagcgtcttgcccagcaggatatgtttgtgttgcctgctccattccatcatcaaccggtaggcttccgtttcttccttttgaatattaaccacctgactgataccgatatacgcataatacaaatcaggtttctcttgaagaacttgaagcgccaaaactgaaccccacgaatagccggcgatatatatttttctcctgctgaattgcttgcataagcgttcggtcagatgaatggtgtcagctgtcagctgatccaaagtcatagatgaacccggaatttcctttgaataagagagacccgcccctctctgatcccagttcacaacggtgaaatgcttttccagctcattctggtattttctcgcataaccgatttgaggcgtgccgggaccgccatgcaaaaacaaaagcagcggactactcctgtcatcaccattaatcataatggtttgttcactgccattaatctgcaattgctgaagcattgaaatacgattggttttcttgaagttatcgttcatcggtctgctcctaaaatttgtatacgttctattatacatggaatcagcagggaaacaaaaaaacgaggccccataagggaccccgcattattgaacgagtcgattactcagtgattgtagaaacaacgcctgaaccaactgtacgtccgccttcacgaatagagaaacgagttccttcttcgatagcgattgtagagataagttcaacgatcatttcagtgttatctccaggcataaccatttctacgccttctggaagattgatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgtccacgttggatgtcttcacgagctacaccgcgaagaagtgcaccgatgttgtctccagcttcagcgtagtcaagaagcttacggaacatttcaacacctgtaacagttgttttgctgttttcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcatcaactgcagccataagttcaagaattttttcttcgtactcagcatcgccttcaagagctttaagagcagaacctttaacaactggtacatcatcaccagggaagtcgtattcgctaagaagatcgcgaacttccatttcaacaagctcaagaagctcttcgtcgtctaccatgtcgcatttgttaaggaatactacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtgtcagtttcgtactcaacgtgtgcagtagagattgtgataccgcgctcacgttcttctggagcaccatcaatttgatcgtacgccatagctgtacctttaccagatttcttatgaagtactgttgagatagcagcagttaatgttgttttaccatggtcaacgtgtccaattgtaccgatattggcatgtgatttggaacggtcgaatttttctttagccattctaaaatcctccttaagagcttttaattagtaatgtatagagtgatagaaagtgaaagcaagctctcacttcctcatcttacaatagtagttatacttgagttaagtggcaaaatcaattattcgcctttattttttttgataatttcttcagcgatgctcttcggcacttcttcgtagtgatccatgaacattgtgaacgtaccgcgtccttgcgtgttagaacgaagggcagtagcgtaaccgaacatttcagcaagaggtaccatcgcacgcacaacttgagcgttaccgcgagcttccataccttctacgcgtccgcgacgagaagtaacatcacccatgatgtctcccatgtattcttcaggaataacaacttcaactttcatgattggttcaagaagaactgggttacatttgctgactgcatttttcaatgccatagaagcagcgactttaaacgccatttcgtttgagtcaacatcatggtaagatccatcaaaaagtttcgccttgatgtcgattagcgggaatccggctaggacaccattttcaagagagtcttcaagacctgcttgtacggctgggatgtattcacgaggaacaacaccaccgacgattgcgttttcgaattcaaagccagcgccttcttcgttcggttcaaattcgatccaaacgtgaccgaactgaccgcgtccgcctgattgacgtacgaatttaccttcaacttttgcaccggtacggaatgtctcacggtacgcaacttgaggagcaccaacgttagcttcaactttgaactcacgcttcatacgatcaacaatgatatcaaggtgaagctcacccataccagagatgattgtttgacccgtttcagggttagtttgtgtacggaatgtaggatcttcttcagcaagtttcgctaaagcgatacccattttatcttggtcagcttttgatttaggctcaatcgctacgtcgataacaggctctgggaattccattgattcaaggattacaagatccttttcatcacacagagtatctccagtagaagtatcttttagacctacagcagctgcgatgtctccagcgtaaacagtagagatctcttcacggctgttagcgtgcatttgaaggatacgtcctacgcgctcacgcttgccttttgtagagttctttacatatgaaccggaatcaagtgtaccggaatatacgcggaagaatgtcagcttaccgacataagggtcagtcataactttaaatgcaagtgcagagaacggctcttcatcagaagaatgacgaacgatctcttcatctgtatcaggacgaacacctttgattgcagcaacatcagttggcgcaggaaggtagtcaagaacagcatcaagtacaagctgaacacctttgtttttgaaagcagaaccaacaagtacagggtagaattcaacattcagtgtacctttacggatagcagctttcagttcagggatagtgatttcttcaccttcaaggtacttttccataagctcttcatcaagctcagctacagcttcaatcaggctgctgcgaagctcttcagcttgctctttgtactcttcagggatttctttcgcatctgaacgagttccaaggtcatcttcgtagaaatacgcaacgttttctactaagtcgatgataccttcgaagttgtcttcagcgccgatcggcaattgaattgcgtgagcgttagcttgaagacggtctcttaaagtgcctacagagtaaaggaagtctgcgccgattttgtccattttgttgacaaatacaacgcgcggtactccgtaagttgttgcttggcgccatactgtttctgtctgaggctcaacacctgattgagcatcaagtacggcaaccgcaccatcaagtacacggagtgaacgttcaacttcaactgtgaagtctacgtgtcccggtgtatcgatgatgtttacacggtaacctttccactgtgcagtcgttgctgcagaagtgattgtgataccgcgctcttgttcctgctccatccagtccatttgcgaagcaccttcgtgagtttcgccaattttgtggatacggcctgtgtagaacaagatccgttctgtagtagtcgttttaccggcatcgatgtgagccatgatcccgatattacgagttttttctaaggagaactctcttgccattgggtaatttctccttccttattagggaattattattttgattatatgaatcctaccagcggtagtgagcaaatgctttgttcgcttctgccatcttgtgagtgtcttcacgtttcttaacggcagcaccagtgttgttagctgcatcaagaatttcgttagccaggcgctcttccattgttttttctccgcgaagacgcgcatagttaaccaaccagcgaagaccaagagttgtacggcgttcaggacgaacttctacaggcacttggtagttagctccacctacacggcgtgcttttacttcaagtacaggcatgatgtttttcaatgcttgttcgaaaacctccattgcatcattgccagtgcgttctttaatgatatcgaatgacttgtataggattgtttgagatttaccttttttaccgtcgatcatcattttgttgatcaggcgggataccagcttagagttgtaaagcggatcaggtaaaacatctctttttgctacaggacctttacgtggcatctgaatatcctcccttcatagttttaatgatttattattattactttgctttaggacgtttcgtaccgtatttagaacggccttgcgcacggttttcaactccggcagtatcaagcgcgccacgaacgatgtggtagcgtacccccggtaagtcttttacacgtccgccgcggatcagtacaacgctgtgctcttgcaggttgtgaccgataccaggaatgtaggcagtaacctcgattccgttagtcaaacgaacacgagcatatttacgaagtgctgagttcggttttttcggtgtcattgtaccgacacgagtacataccccgcgtttttgtggagaagatacgttagtgtgctcttttttaaagctgttgtatcctttgtttagtgcaggtgacttagagttttcaactttgctcacgcgtcccttgcgaattagctgattaattgtaggcatgttgtgttcctcccttcattacgttttataacccacatacccaggtggttcatcattaggcaaaaaaacaatgtctttacataagattgatatcttatataaaaacaaaaagtacgctataacataatggcaacagctgctgctcccacttcaattccgcaggctttgccgagctttttcatggaatccaccatacagacagcggtattttggttctttgcaagctggataacgccagccgtaagaactgaatccgcgtcttttgccacgacgacttccttcactgaacctcgttttagagctttcactgtttgcttcgtaccaataataattgatttggcctgtgatactttatcataagacataaacatatcctccaaagtaacaggttttatttcgagcaccttggttatattatcactctgcgggacggatgtcaacaacgtatgacattttttagtgcagtcccccgccagaataattgtaatactgaggaaaagctgtcgaaacagcctttcctgcagcagtttctgttattcagccggaaccatatcttccgaaggctgaacgtttgaaacaggttttacttttctgtaattcatcatacctgtaccggccggaaccagtttaccgatgatgacattctctttcaggccgagaagttcatcacgcttgcctttaatcgcagcatctgtaagaacgcgtgttgtttcctggaatgatgcggcagacaagaatgaatccgtctcaagtgaagctttcgtgataccgagaaggacaggacggcctgtagcaggtcgattgccttcaagcagcacttttttgttcgcttctgtaaattggtgaatatcaagcaatgtgccagggagaacatcagtatctccggcatcgattacacggactttgcgaagcatctggcgaaccattacttctacgtgtttatcgccgatttcaaccccctgcatacggtaaaccttctgaacctcatgcagaagatattcctgaaccgttgtcaggtcagtaactttaagaagttctttcggatcgattgaaccttccgtcagcacttgaccgcgggtaatctgatcaccctcagtcactttcaggcgtgagttgtaaggtgccgtgtatgaacgggtctcaacagcaccctgaacaacaatctcctgctgtttgtcgcggacttcattgatttcggcaattgtaccgtcaatctcagaaatcgtcgcttgacctttcggattacgcgcttcgaaaagctcctggatacgcggaagaccttgtgtgatatcgtctccggcaaccccgcctgtgtggaacgtacgcatcgttaactgtgttccaggctcaccgatagattgagcggcgataatacctactgcttcgccgacttcaacatcagttccggttgcaaggtttcgtccgtagcatcgtttacatacaccatgaggagtgttacatgtgaacgcagaacggatccacacttcttcgattccggcttcaacgatttccagcgctttatcttcatcgatcaattcattttcgttaatgagcacagcacccgtttcaggatgtttgatctgttttctggcgaaacgtccgatcagacgctcttccagacgctcgatgatttccgtgccttctttgagcggttttgcaagaataccgcggtctgttccgcaatctgtttcacgaatgataacatcctgcgcaacatcaacaagacggcgtgtaaggtaacctgagtcagctgttttcagggcggtatcggcaagacctttacgcgcaccgtgagtggagataaagtactccaatactgtcagaccttcacggaaacttgatttaatcggcaattcaatgattcgtccagccgggttggccatcagaccgcgcatacccgcaagctgtgtaaagttagatgcgttaccacgggctcctgaatcactcatcatgtagatcgggttgacttcgtctaatgatttcatcagtttgccttggataacatctttcgctgaactccaaattgaaatgactctttcataacgttcttcttcggtgattaaaccgcgtctgaactgtttcagaacattatctactttgctttgtgcttcttcaaggatttcctgtttatcatcgagaacgacgatatcagaaacccctactgtgatgccggctttcgttgaatatctgaaaccgaggtttttcatgcggtcaagcattttagacgtttccgtgatatggaatcgtttaaagatttccgcgatgattttacccaaaataccttttttaaacggtgcgttgatcggctgctcagcaatcacagcttttacgtcagcacctttatctaagaagaaacggtcaggtgtcttctcttcaatgttgctcttcgttggttcattcatgtaagggaatgattccggaagaatttcattgaagacgagcttaccgacagttgtaattaacaattttgaacgctgttcttcagtaaatgtcacattcttaagggagttcgctgcaacagctactctcgtatgaagatgaacataaccgttttgataagcaagaagcgcttcgtccgtatttttgaaaaccataccctcgccgactgctccggcgcgctcaagcgtcaggtagtagtttcctaataccatatcctgagacggcgtaacaaccggtttaccatctttagggttcaagatgttttgggccgcaagcatcagaatgcgcgcctcagcttgagcctcagctgataaaggtacgtgaaccgccatttggtcaccgtcaaagtcagcgttataagctgtacatactaacgggtgaagacggatggcgcgtccttcaacaagcgtcggttcgaaagcctggatacctaatctgtgaagagtaggggcacggttcagtaagaccggatgctccttaatgacagattcaagtacatcccatacttcaggctgcacgcgttcgattttgcgttttgcgctcttgatattgtgagcaaggcctttttcaacaagctctttcatgacgaaaggcttgaagagctcaagcgccatttccttcggcaaaccgcactgatacattttcagatgcggacctacgacgataacggaacggcctgagtagtctacacgtttaccgagaaggttctgacggaaacgcccttgtttccctttcagcatgtgagaaagagatttaagcggacggttacccggtccggtaaccggacggccgcggcgtccgttgtcaatcagagcgtcgactgcttcctgaagcatacgtttttcgttctgaacgatgatgcttggcgcgccgaggtctaacagacgttttaaacggttattacggttgatgacacgacggtaaaggtcgttcaggtcagacgttgcgaaacgtccgccgtcaagctgaaccatcggtcttaattcaggcggaataaccggaagcacgtcgagaatcatccaagacggcttgtttcctgaattacggaaggcttcaagcacttcaaggcgtttgatcgcgcgtgtacggcgctgtccttgagaagtcttcagctcttcttttaacatatcaacttctttgacaaggtcgatgtcctgcagaagtttattaatggcttccgcacccatagaggcttggaatttgtttccgtacttatccagatacgcacggtattccttttcagataaaagctgtttcttttcgagcggtgtattggccgggtcagttacgacgtaagaagcaaagtaaataacttcttccagcgcacgcggtgacatatccaatacaagacccatacggctcggaatacctttgaaataccaaatgtgagaaaccggggcagccagttcaatatgccccattctctcacgacggactttagcccgcgttacttcaactccgcaacggtcacaaactacgcctttataacgaacccgcttgtacttgccgcaatgacattcccagtccttagtcggtccgaaaatgcgttcgcagaacaggccgtccttttcaggtttcaacgtacgatagtttatcgtttcaggctttttcacttcaccaaaagaccatgaacggattttatccggtgaagcaagaccgatgttcatatactcaaaattgttcacatctagcaaggggcctacctccctttttatcttcggattaaccgatgtcacttgcctttatcaatcagagactattctttcgttactgcgtcacgttcaacgtctggagatgctgtttcttccggcgcttcatcacctgataatgcaaggccgtcagcctgtttcgcatcttcctcgtcttctagatctctcatttctatttcttcttcatcgcctgagaggatttttacgtccatacctaagctttgaagctctttgatcaatactttgaatgattccggaacaccaggctctggaacattgtcgcctttgacgatggcttcatatgttttcacacgtccgaccacgtcatcggacttcacagtcaggatttcttgaagcgtgtaagctgcgccgtaagcttcaagcgcccaaacctccatctcaccgaaacgctgtccgccgaattgggctttaccgccgagaggctgctgcgtaacaagtgagtaaggacctgtagaacgggcatgaagtttatcgtcaaccatgtgagccagtttgatcatgtacatgattccgactgatacacggttgtcgaacggttctcccgtacggccgtcataaagaactgttttagcgtctcttgacatgcctgcttcttcaagtgtttcccacacatcttcttcacgcgcgccgtcaaatacaggtgacgcgatgtgaatgccgaggtagcgggcagccatacccatgtgaagttctaatacctgaccgatattcatacgtgatggtacacccagcgggttaagcatgatatcgatcggcgtgccgtcaggaaggtaaggcatatcttcttcaggaagaatcttcgagataacccctttatttccgtgacgtccggccattttatcaccttcagaaatcttacgtttctgaacgatatatacgcgtacaagctggttcactcccggaggaagttcgtcgccgtcttcacggttgaagacttttacgtcgtggataattccgccgccgccgtgaggcacacggagagaagtatcacggacttcacgcgctttttctccaaagatcgcatgaagaaggcgttcttcagccgtaagctcagttacacctttaggcgttactttacctacgagaaggtctccgtcgttgacttccgcgccgatacggataattccgcggtcatcaaggttgcgaagcgcgtcttcccctacgtttggaatatcgcgggtgatctcttccggcccaagctttgtatcacgtgcttctgattcatattcttcaatgtgaatagatgtgtatacatcatctttcacaaggcgttcactcatgatgatggcatcctcatagttgtaaccgtcccatgtcatgaagccgaccattacgttgcggccgagagcaagttcaccaagctccattgaaggtccgtcagcaaggatttctcctttgactacttcatcgccgacacttacaatcggacgctggttgtagcacgtaccttggttggagcggacaaatttcagcaagctgtacttatccaggttgccttttactttttggccgtcaatttcttcatagcggcgcacccatacgtttttcgcttccacccgttctacgataccagggtgtttacaaataacggctgcaccggagtctttaccggatacgtattccatacccgttccgacgatcggagcttccggctgcatcaaaggcacagcctgacgctgcatgttcgctcccatgagggcgcggttcgagtcatcgttttccaagaacggaatacatgctgtcgcagcagaaacaacctgtttaggagatacgtccatgtaatccacgcggttgcgggctacaacggtgttttcccctctgaaacgcgctacgatgctgtcatccaagaaagaaccgtcatcgctcagcttagcattcgcttgggctacgacatagttatcctcttcatcagcagtcaggtagtcgattctaggcgttacttttcctgtttcaggatcaacgcggcggtatggcgtctcaatgaaaccaaagcggtttactttcgcaaatgatgacaatgagttgatcaaaccgatgttcgggccctcaggcgtttcaatcggacacatacggccgtagtgagagtagtgaacgtcacgtacttccatacctgcgcgctcacgcgtcaaaccgcccggtccgagagctgacagacggcgtttgtgcgtcaattcagcaagcgggttcgtctgatccatgaattgagaaagctgtgagcttccgaagaactctttaatagacgcaataacaggtctgatgttaatcagctgctgcggcgtaattgtattcgtgtcttgaatagacattctttcacgtacgacacgttccatccggcttaaaccgatacggaattggttttgcaggagctcacctacagaacgcagacggcggtttccgagatggtcgatatcatcagtgtcgcccactccgtgcaggaggttgaagaagtagctgatagaagaaataatatcagcaggcgtaatgtttttaatcgcctcttcgatgtaagcattgccgatcacattgatcgtctgctctccttctgcatcagtaggagcatagattttaatggattgaagcatcacttcatcctcgacaacgccgccgttaggataaagttttctgaagccgattccattttctaagtatggcaatactttatcaagtgttcttctgtcaagaatctgccctttttcagcgagaatttcaccggtttccggatccaccagtgtttctgcaaggcgctggttaaacaggcggttcttgatatgaagctttttattaattttatagcgtcctacattcgcaaggtcgtatcgcttcggatcgaagaaacgggaatccagcaagctttttgcgttttctactgtaggcggctctccgggacgaaggcgctcatagatttcaagaagcgctttgtcactgttttcggtgttgtccttatccagtgtattgcggagatattcgttctcaccaatgagatcgagaatctcttggtcggaaccgaagccgagagcacgcaaaagaaccgtaaccggcaacttacgtgtgcgatcaatgcggacatacacaacatctttcgcatcagtttcgtattctaaccatgcgccacggtttggaatgacagtcgcggtaaaaccttttttaccgtttttgtctactttaccactgaaatatacacttggagaccgaacaagctgagatacgataacacgttctgcaccgttgatgataaaagtaccggtatctgtcataatagggaaatcacccatgaagacatcctggtcttttacctctccagtttctttgttaattaaacgaaccttcactcttagcggagctgagtaagtcacatcacgttcttttgactcttcaacgggatacttaggatctcctaaactgtagtcaatgaactctagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatctcttacgataaagaaatacttttacaagacaaaagaaaaaagggtttctaattaagaaaaccacatccaaaaacaaataccgattttattagcatttccatgtttgtataatttatacatgcactatgattatttgagcatatcatgcaaaatatatacattggcattttacaatattaacatagctgaaaattcaagtcaaactttttttgcttttatgatataatagcctttctttttttgaaccacagaaacttcgtcaaaaagctccttcagtttttcaatggcagaaggcccgccctgttttttctgtataacgatccacaattcacctgaagcccttaaatgctcagcgcttttttcaaaaatggcatggacaactttttttccggcgcggattggggggtttgtaataatagaagcaaatgtttgagcagaatcaatatttgaaaataaatcactctgataaatccgaacgttttttattccgtttttttctgcattttcatttgacagctctacggctctttcattcacgtcaatcatgtgcacggtccggtctgtaaatgcaccggcgagcgacagaccgatcgggccgtaaccgcagcctgcatccaggaagtcaccatcgatctccggctcttcaaacgcttcaattaagacacgcgaaccgaaatcaacttcctttttcgagaaaacgccgctgtcacttgtgaatgtataagatctgttccgcagtgtaaatgaccatgtctgtttatcgcttttaactgaaggtttttctgaataatagtgttcactcattattagaacctccttttttaattgcacttaaagaaaagcaaagaaaaagcccgcctcataaaagcgagcttcccctacaggcaagtgaagattacttaacttctacagaagcgccaacttcttcaagtttagctttaagctcttcagcttcttctttcgcaataccttctttaagtggttttggagtgttgtcaacaagttctttagcttctttcaagccaagaccagtgatttcacgaacaactttgataactttgattttctgagaacctgcaccagcaaggataaggtcgaattcgctttgctcttcagcagcgccgccagcagcagctccgccagctacagctacaggagcagcagcagttacgccaaattcttcttcgattgcttttactaggtcgttcaattcaagtacagttgcttctttaacggaagcaatgatttcttcgatatttaaagccatttgaaattcctccatttgttttattttagggtaaaatcagattaagcgccttgttcttccttttggtctgcaactgctttagctgcaagtgcaaggttgcgaactggagcttgaagtacgctaagcaacatagaaagtaagccatcgcgtgaaggaagttcagcaagagctttcacttcttcaacagaagatacttttccttcgataacgcccgctttgatttccagagcttcgtgatttttcgcgaactcgttaagaacttttgccggagcgacaacatcttcagtactgaatgcgatcgcattcggtccagttaagacatcattcaaaccatcaagttcagcttgttcaaccgcacggcgagtcattgtgtttttgtacactttgaactctacgttagcttcgcgaagctgtttacggagttcagttacttcagaaacgttaagtccgcggtagtcaacgatgatcgttgatttgctttctttcagtttagaagcaatctcttcaacaacaactttttttgtatcaattgcgctgctcatggttacacctcctgtagattttgtgtaacacttataccgctaggtgatcacgactgtgacgacgatttcatataaaaagcctccatgtggacatggaggctgtatatacaagcatacgtaacgtaatagctgtgatatatatacacctcggcaggatattaagcctcaacggcccctgctgtctacggtataaatgacatattatattttacaacattttgaatcatatcagaatgctgatctaaagtcaaatattattttacgttgaaagtagaagcgtctactttgacaccagggcccatagtagaagtaacggcaacgtttttcacgtaaacacctttagccgcagccggttttgctttcaggattgtatcatacattgttgtgaagttctcaacaagtttttcatcctcgaaagaaacttttccgatcggaacatggatgttaccagctttgtcaacgcggtattctactttaccagctttgatttcgccgattgctttttctacttcgaatgtaacagttcctgttttagggtttggcataagaccttttggtccaagcacacggccgattttaccgacttcacccatcatgtcaggagtcgcaacgattacatcgaattcgaaccagccttgctggattttcgcgatgtaatcagaatcaccgacgtagtctgcaccggcagcttcagcttcttttgctttttcgcctttagcgaatacaagcacgcgctgagttttaccagttccgttaggaagtacaactgcaccgcggatttgctgatcgtttttacgagggtcaacccctaaacgaaaagcaacttcaactgtagcgtcgaatttagctgtgtttgtttttttagtaagcgccactgcttcagcgacgtcgtaagctttcgcacggtctacaagcttcgcagcttcaacgtactttttaccttttttagccattttaaaatttcctccttatgtggttatagcggaataacctcccacgaataagggttgcgaacttgtgaaaactcgcaacccgacaagaaacaaattaatcctcgataacgatacccatactgcgggcagtaccttcaaccatgcgcattgccgcttcaacgtctgctgcgtttaagtcaggcattttcgtttcagcgatttcgcgaaccttatcgcgcttaacggttgccactttattacggtttggttcaccagaaccagactcaattccagctgcttttttaagcaatactgcagcaggcggagtttttgtaataaatgtaaatgaacggtcttcgtaaaccgaaatttcaacaggaatgattaaaccagcttggtcagctgtacgagcgttaaactccttacagaatcccatgatatttacaccggcttgacctagtgcaggtccaactggcggcgctgggttagcttttccagcaggaatttgcaattttacaacttttactacttttttagccacgagacacacctccttaagtccgtgatgtggtaatagggtaaaccctcccactcaaggtttcattctttatatgaatgacgaaatatcaagctagctgccttggattagtccaagacgtacctttgctatattatcattaatatatagcaatttcaagttttttcacattacaatttgtcgatctgggtaaattccagctcaaccggcgtttcacggccgaacatgttaacgaatactttcactttgctcttatcataatcaatctcttcaattgatcctgtaaagttggcgaaaggtccgtctatgactttgactgtctcattcaattcaaaatcaatgtcggttttccgctcatccatgcccatccgctttaagatggtttccgcttcgccaggaagaagcggagtcggctttgagcctgaaccggctgatccgacgaatccggtaacgcccggcgtgttgcggaccacataccaggaatcatcagtcatgacgatttcaacaagcacataacccgggaacactttctttttgactacttttttcttgccgttcttaatatcagtctcttcctcttcagggacgacaacgcggaaaattttatcctgcattcccattgattccacacgtttttcaaggttcgcttttactttgttttcataaccggaatacgtatgaacaacataccaattcttttccattctatcaggactctgcagtccttccctccccgcatttaaaaatgaagtgtaaaacaaaaaataggctcagagcctatgaatccttttttcaacacaataaaaaacccgctgaacgggttttggcaaacgatattatgatctattatagcacgtattgctgatcattattcaactattaaacgaattaattgagaaattcctgtatcaaggagggcaaaaaagataacaaaaaagataaccgttgaaatcaccgtgatcgtatagcgcgttaactctttgcctttaggccagctaacctttttcatttctttcccaacatctttaaagaaactcatcatgcgcatgtaaaagacctccacaatttaaaaagcgaacactattttgtttctaaatgagctgtatgtgaattgcaagtgctgcagtacttcttaacttctaaccgctcagccgctgatgcagagcttttcattgtcgtataattacgatttccgcatgttttgcatgccagcgtaatcttttttctcatgtcgttacaccttttcctaaacaatcatttatcttaataaaatagcacagtcagaaaaattctgtcaatatgacacagaaacccgctacagactgatttctcttatttccaaatacttttcaagcttgcgcttcacgcgctgcagggcattatcgattgattttacgtgtcggtttaaatcatctgaaatttcctggtaacttcttccgtccaagtacagaacaagcacctttctctccagatcgctcagcagttctcccattttcatttcgatatcatcaaattcttcctgattaataatcatctcttcaggatttaacgttttagcgcctgaaatgacatcaagcagtgttctgtcagattcttcatcaaaaataggtttgtctaaagaaacataggaatttaaaggaatgtgtttctgacgggtagctgtctttattgcggtaataatctggcgggtaatgcataattctgcaaaagctttaaatgaagtaagcttgtcctctctaaagtctcggatagacttatataagcctatcatcccttcctgtacaatatcttctctgtcggcccctattaaaaaataagaccttgctttcgcccgtacaaaattacggtacttcgtaatcaagtaatctaacgcatcactatccccaacatgaaccttttcaatgacctgctcgtcctccaactggcaaaattgcactttgttgaactttcccttgctgttctgtagattcactgcgatccccccggcgcacgtagatagaaatattatacattaatgggcgaaaaagcgtcaacctaatccagaccgcctcggcgccacttttcaaacgttttcaaaacctcttcggacagctcgattttacccggtggtttttcagaagtgatctttgaaacccgcctttgaatccgccgttctatcgtatccacttccctcagaagctcccgggcggatttgcggagagccccttgtccgaaaatcgcccactgctccgtataatcggaggttgcgacatgaatctgtgtcgcaatattattcagcgcctgggcaagtttctcgatccgctcatccgccgtctcattctcccgtgtaaaaatcacttcgactctgtgattcgtttgttttttctctatgccttttaccagatgtgcgtcaaacaccacaatgactctgattcccgtgtaggactgatattccgccatcttctggatcagtacatctctcgcttcttcaaaactgttcgcttttaaatcctttagctgcggccaagctccaatcatgttgtatccgtctactaacaggatgtccatctgtcattattcccctaaaggattgcgcttccggtagacttcatacatgagaaggccggccgctaccgacgcattcagagacgtgacttttccggccatcggaagtttaatgagaaaatcacatttctctttcacaagccggcccattcctctgccttcgcttccgataacgagcgccaaaggcatcttgccgtccatagagcggtagtcttcccgggcggatgcatccgttccgacgacccaaatcccccgctccttcatttcatcaagtgtccgggcaaggttggtcaccttcacgacgggaatgtgttcaatcgcaccggtcgaagcttttgcgaccgtcgatgtcagtccgaccgctctgcgtttcggaatcacaatgccgtgtgcaccgacagcgtcagccgttctcatgatggaaccgagattatgagggtcttccagctcgtccaatatgagaaagaaaggctgttcgtttctctcttccgctcttttatataattcgtctaattgtgcatattcatatgccgccacctgggcgacaacaccctgatgctgcccctccaccatctgatcgagttttttcctcggtacaaattgaatggtgacgccgcgctttttagcaagctccataacttgctgcgcctgtccttttactgtgttttccgccatccataacttatacagcttgcgatctgactttaacgtctcaatcacagcgttttttcctatgacgtaatcatgttgctgactcatttgttttcctccctgacgtcccgacttgtatagcctcagcaatcagctgattcagtctttcttctcttttctcaagaaaaaggtatccgagtaaagcctcaaaagctgtactatggcggtacgtctgtacatctgtgtttttaggcgtggtccctgatttcgcgtttctgcctcttctcagcacggcttcctcttcctccgtgaaaaaggattcgtcctgaaggcggaacaatatgtctgcctgtgattttgccgatacaatccggctcgccttcttatgaaggtcattcggtttcgtaaagccctgcttaagcaggtgatgccggacgtatatttcaaaaatggcatcacccatataagcaagcgcaagaccgtttaactgctttgaatctttgatttgttcaaattgaagcatccgcttattctccccgcttccagcgagttccctgggctgtgtcttcaagaatgatattcatgcttttcagctgatcgcgaatctggtctgacaaagcgaaatcgcgattgcggcgggcttcatttctcttctcaatcaactcttcaatctcttcgtcgacaagctcttcttcgccgagcgtaagtccgagaacagatccgattctgtcaaacatgctgataaaggctttaatgacgtgatccgccgtattgtcttcctgcatgtagtaattggcgagcttcgccagatcaaaccaaacggaaatcgcattcgccgtattaaaatcatcatccattgcttcttcaaacgaagcgcggtgctcttcgattttagcgagccattcctcatcattgtcagtcagattcgtgctgctaatcaaacgatggtttaaattactgtatgccgtcttgaggcggttaaacgcgttttttgttttctcaagcagctcttccgaatagttgatcgggtggcggtaatgaacggaaagcatgaaaaatctcaaaagctgcgggtcatattgcttaatgatatcgtgcaccaaaacaaagttgccgagcgattttgacattttctcattatcgatattgatatatccgttgtgaagccagtattttgcgaatgtcttgcctgttaatgcttcagattgcgcgatttcgttttcatggtgcgggaatgtcaggtcctgaccgccggcgtgaatatcgatttcgtcacccaaatactttttcaccattgcggagcattcaatatgccagcccgggcggccttttccccaagggctatcccatgaaatttctccgtccttagcagctttccaaagcgcaaagtccagcgcatcctctttcttctcgccgacacggatacgcgcgcctgatctgagttcatcaattgattgctgagatagcttgccgtagccttcgaaggcccttgttttgaaatagacgtcgccttctgattcataagcgtagccttttttaatcagctcgctgacaaattcaataatggcgtccatgttttccatgacccgggggtgaagatccgctttccggcatccgagggcgcccacgtcttcaaaatacgctttaatgaaccgttcagaaacggtcgggacgtcctcgccgagctcgttggccgctttaatcagtttgtcgtcaacatcggtgaaattcgatacgtattgaacatcgtatcctttatactccaaatagttgcgtacggtatcatacacaatcgccggacgagcgtttccgatatgaatatagttgtatacagtaggtccgcacacgtacatttttactttgccttcctcaagaggaacaaatgtttcctttttccgtgtcaatgtattataaagtgtaatggtcatttttggttgatcctttcttttttatcttccagttcagcctgcagttcaaaaatctgctgctccaatgctctaaaccggtcagcaaccggatcgggcaagtcttggtgattgagatcgcgtttgatttttcttccgttctgaatgacgactttccccggtatgccgacaacggtcgaaaagtcgggaacatcacgaagcacaacggagccggcccctactttagaaccctgcccgaccgtaatagagccgagcaccttcgctccggttgcaattaaagcatcatcttttatggtcggatgccgcttccccttttcttttcccgttcccccgagagtgacaccttggaataccgtcacgttattgccgatttcacatgtttcccctatgacgacccccataccgtggtcaatgaaaaaccttctcccgatggtcgcgccgggatggatttcaattccggtaaagaaacgggcaatctgtgatatcaggcgcgccaggaagaaaaatctccgtttatataaagcatgtgcaatccgatgcgcccatatagcatgtaaaccagaataagttaaaacaacttcgaaatagcttcttgctgccggatcttgatcgaacactgtatctatgtcttcttttagcattttaaaaaacacatgcttccccccattctctccccgctccagtctgtttttccgcctataaaaaaagcgcctctgcatgtaaacatgacagagacgcttttaccgcgcggttccactctgtttgaaaaacaagtcaatgttttcccaacttaaaagccggtaacggcggcggccgcctttaaatactgatttccgcagaaatgttcttcaaaggtcttaagggcgcacttctaaaacatgacgcatgaatctctctcagccgatgaagattctttctgtaatggtcattgttttatactcttccctgtcaacaatcgtatatttaaatgcttttcaggcgtctgacggctgtttctctgccgatcagctcaatggcctgcggaagctccggaccgtgtgtctgaccggtaaccgctacacgaatcggcatgaacagctttttgcctttatggcctgtttctttctgaacagctttgattgaggctttgatcagctcaggcgtaaattcttcaagctcttcaagcttcgcagcaaatacgctgagcacttcaggcacctgttcttcttccagaacggcttttgcctcttgattatactcgatctcatctttaaagaacaaatcagtaagctcgacaatttcagcgccgtagctcaattgctcatggtaaagagagattaatttacgaacccattcctgttcttcggcagaaagctcagtgccgacttttcctgctttttgcaggtgcggcagggtcagctcaaccacttgatcaagatccagcgctttgacgtattggttgttgacccatttcagtttatgcatatcaaacagagccggtgacttagacaaacgatttacatcaaaaatttcaatgaattgttctcttgtgaaaagctcttcttcaccgacgggagaccagccgagaagtccgataaagttaaacagcgcttcaggcaggtaacccagctcatcatactgctcaataaactggataattgattcatcacgtttacttaattttttgcggctttcgtttacgataagcgtcatatgtccgaagacaggaatatcccagccgaatgcctggaaaatcatgatctgtttcggtgtatttgaaatgtgatcctcaccgcggagcacgtgcgtcattttcattaagtaatcgtcaatcgcgacggcaaagttatacgtcggtgttccgtcttttttgacgatgacaaagtcgccgatgccgtctgattcaaaagaaatctcgccttttacgatatcgttaaatgcgatgattttcccttccggcacgcggaaacggatgctcggctgtctgccttcggctaaaaactgctcctgctcttcctgagtcaggtttctgtgtttgccggaatagcgcggcatttccccgcgggcgatttgctcttcacgttctttttcaagttcttcttccgtacagaaacatttataagcaagccctttttcaagaagctcttcatagtactctttgtaaatgtcgttacgctcagactggcggtacgggccgtattctccgccgacatccacactttcatcccagtccatgccgagccatttcaaatagttaagctgactttgctctccgccttcaatatttcgctttttgtccgtatcctcaatccggataataaactttccgccttggctgcgggcaaataaatagttaaaaagcgccgttctggcgttaccgatatgcaaatgtccggtcggactcggtgcataacgaacgcgtacttcatttcccatgttcaaatacttcctttcatctcgtctgtagcctctagccgaatatatgtatctattctaccaccaaatagacccggcatcaaaacaatgatcaggctttttgaatcagaacggttgcctgagcggcaattccttcggctcttccggtaaacccgagcttttcagtcgtcgtcgcttttacgtttacttgagagacgtccgcctcaaggccttccgctatccgttttctcatagcatcaatatgcggcgccattttcggcttttgcgcaataatcgtgcagtctatatttccgagtacgtaccctttttcttttacaatgttccagacatgctgaagcagcttaaaagaatcagcatccttgaattccggatcagtatccgggaaatgcttgccgatatctccttcacctgccgctccgagacacgcgtctgcgactgtatgcagcaatacatcagcatctgaatgtccgagcagtcccttttcataaggaatttcaattccgccgatgatgagcggacggccttccgttaattgatgcacatcaaatccttgtccgattctaaacattatgattcccactttccgctttcatgattgcttccgcaaatatcaggtcatccggcgttgtcagcttaatattggtatagctgccttcaacgatactcacctgatatccatcaagacgctcgacgaggctggcgtcatccgtacctaagaagcctttgttttccgcttccatatgcgccgtcttcaataaagaaagacgaaaagcttgcggcgtttgaacggcccacaagcttgaacgatcaaaggtctccgcagcccgggagccttccgcccgttttatcgtgtctttcacaggaacagccaggacagccgctcccgcctcctctgctgtttcaacgagcttatcgatatgctgatgtgtgacaaacgggcgcgctccgtcatgaacaagcacgaccgattccttatcaatcactttcagtccttcgtatacactgtgctgacgctccgcacctccggtaacaagctcaatttccgtctgaatcggaaattggaccagcagctggcgaaaatcttcccgttcactctcgtttatcaccaggattattttctgacagggtgcgtggctttcaaaaacccgcagtgtgtgtataataacgggcgcaccttttaagctgatgaacagcttatttttcccggccttcatccgttttccttgtccggcagccggaataacgacaacatactccatatgaactccctcttaaagagctttctcaagcagcttgggcttggcaaaaatcattcgtcccgccgctgtctgcagtacgctggttacgagcacatcaatatgtttccctatataattgcggccttcttccacaacaatcattgtgccgtcatctaagtaagccacaccttgattatgctctttcccgtccttaatcacctgcacattcatctcttcgcccggaagcacaaccggcttcaccgcgtttgcaaggtcattaatattcagtaccgcaaccttttgaagctcgcatactttatttaaattaaaatcattcgtcacaacgacaccggatgtcagcttcgcaagtttgacaagcttgctgtcaacctcctgaatgtcttcgaagtcgccttcataaatttcaaccgtaatatccagttccttttgaatgcgattcaagatatccagtccgcggcgtcctctgttacgttttaaaacatctgaagaatcagcgatatgctgtaattcctccagcacaaattgaggaatgacaatgacgccttctaaaaagcccgtctgacaaatatctgcaattctcccatcaataataacacttgtatccaagattttcagccttttatcctgttcttcctgctcctcatcagcacttccctttttcttctgcattcttgcagaaatggagaaaagactgatcagttcatcctttttcttaaatccgacttggaagcccagataaccgagaaagaaagccagaaagaccggaatgatggtgctgaatatacggtacggaatattgtccagcggaatcacgtttacaatgagatatgcgatgataagtccaaaaaccaatccgagactcccgaataacagatccggcaccggagctctcagcaaagaatcttcaatccattttacccaattaatcacatattctgtcgtccatatactgatgagaaaaaagataatagcaccaattgcagcagacgtatatgcgtttgttattaaaggtatgtcctgtatatttgacagcacaaacaattcaggtattaaaaagataccgacaacgccgcccacaataatgaagaacgcctgaactattcgttttaacatacctccacctccttttaagtagcattttttcagcagactgtcagagcctacaaattcagaataaacaaaaactaacaataatatacccggattccgacaggtttaagcgatacttaaagctgtctatctatatagtgtttttcctgaaggcgttttaagccttttttgattttttgggcgcgcacttcgccgataccctcgacatcatcaagctcttctacagtggcttccgttatgctgggcaaaaatccgaacgcctcaaccacattttcaacaatcggcatcggcagacgcggaattttgttcagcagcctgtagcctctcgggagcacataatcatcaagattcgtagaagccgggtatccaagcagtttaaacagaatggaatcatccagcagatcatagctggacatatcctggagctcttttaacagcacgaacggatctttgattttttctttgacatagtctttgatgaaaagtgccgcctcttcttccatgtccgtaatcagttcaatcacctgcagacggattaagtgtccttccgttccgagttctttaatatacatattgatttcattttttattcggagcaccatttcataccgatgcatgacagacagcacgtcactgaatgtcacaagctcctcaaactctaatgcgtttagagccgtaattgttttgtctaaaatggttttatacttctcgagcgtttgaatggcctgatttgcctttgttaaaataaaacctatgtcctttagtgtgtacttcatgctgtcctgatataacgtaatgacatttctgcgctcagaaatggcgatgacgagacagccggtctgcttcgccacccgttccgccgtacggtgcctcattcccgtttctgaagaagaaatggtcgcctccggcataagctgtgtattcgcataaagaattttctggccggaatcacttaaaataatggcaccgtccattttggccagctcgtataagtgagcgggcgcaaatgatgtattaatatgaaaaccgccatcgacgacttgctttaccttatcattgtatccgacaacaatcaggccgcctgtatttgcccgaagtacattctctatcccggctctgagcggggtgcccggtgcaacgaactgcagaattgcagacaggtcaagctcttgtttcgccccttttttctctttttccatctattatgatcctcctaatgaagtacgaagcgcttctgcaacatttgctactccgacaacctcaatcccttttggtattgtccacccatctgcattcgcctcaggtatgatcatgcgcttgaagccgagtttcgccgcttcttttacgcgctgttcgattcttgacaccctgcggacttctcctgtcagtcccacttcaccgataaagcaatctgcgggattcggcggtgtatctctgaagcttgaggcaatgctgacggctactgccaaatcaatcgccggttcatccagtttgaccccgccggcgacttttaaatatgcatcttgattttgaagcaaaagacccacccgcttctcaagcacagccataattaacgataccctgttgtggtcaatgcctgtagccatgcggcgcgggtttccaaaactggtcggtgatatgagcgcctggatttcaaccagaatcggtctcgttccttccattgacgcaacgatactcgaacccgatgccccggcagaacgctcttccaagaaaatttcagaagggttgagcacttccgtaagcccctcttcccgcatttcaaagatgcccatttcatttgttgagccgaaacggttttttacggcccgcaaaatacggaatgtatgatgccgctctccttcaaagtatagaacggtatcgaccatgtgctcaagcaatctcggccctgcgatcgatccttcttttgtgacgtgtccgacgataaaaataggtatgccgtttgttttcgcgattttcatcaattcggccgtacactctcttacttgtgatacactgccgggagctgaggtgatatcactttggtaaacggtctgaatggagtctacgacaacaaatgcgggtttcatctcttgtatagcagacgaaatatactccatatcggtttcagataaaacatgtaacatttggctgttgatgccaagtctgtcggcgcgcagcttcgtttgcttcacggattcttcccctgaaatgtaaagcacgctgccggccgtatctgctaattgtgcggatacttggagaaggagcgttgattttccgatcccgggatcgccgccgatcaatactaacgagcctttcacaacgccgccgccaagcactctgttgaattcttcgagctttgtttgaacgcggggttcttctgatgtttcaattgatgtaatgggtgatggtttctggacggtttgaacggagtgggagaaagccgcccgccgattcgccggcgctttttttatggtttcttccaccattgtattccaagccccgcagcccgggcactttcccatccattttgcggattcataaccgcatgagtggcagatgaattttgtttttgatttagccatatatgttgtaagacctcttccttatcgaatatttctctatataacaaagtgaggcatacactcgcttacgtatgcctcatgtttgtcactatattagttcgttttagcagttgtttttacgacaaattcgccgtcctcaacatcaagaacaatgtgttggcctttatcaatattgcctctgaggagttcttctgataaccggtcctccacatgcttttgaatcgctcttcttaacggacgtgcgccgtattccaaatcgacgccctcttctgctacttttgctttggcagcatccgtcagctcgatagagagatcttgttctttcagacgttttgttaactgatcagacataagcgacacgatgtctgtaagatgttttttctcaagggagtggaagacgataatttcgtcaatccggttgataaactcaggtctgaaggcacgcttcaactctcccatgactttgtctttcatgtctttatggttttgtgattcatcctggacattgaagcctacatatttgttgcgcttcagctcgctcgccccgacgtttgacgtcataatcaggatcgtgttgcggaaatccacagtgcgtccttttgaatcagtcaagcgtccgtcttcaagcacttgcaggagaatgttaaacacatcagggtgtgctttttcaatttcatcaagcaatacgacagagtaaggttttcttctcactttttctgtcagctggccgccttcatcatagccgacatatcccggaggagaaccgacaagacgtgaagtcgagtgtttctccatgtattcggacatatccactctgatcatcgcttcctcatcaccgaaaatggattccgccagcgctcttgccagctctgtcttcccaacgcctgtagggcctaagaagatgaatgaaccaatcggacgtttcgggtccttcagtccggctcttgcacgtctgacagcctttgccacggctacaacggcttcatcctggccgatgacgcgggaatgcagaatgctttccatattgagaagcttatctgtttccgtttgggcaattttagatacgggcaccccggtccagctggatacaaccatcgcgatatcctctacagaaacttcggagttctcctggccttgtttttctttccaggtttttttcgtgtcttccacctgttctctcaggcgctgctccgtatcacgaagggaagccgctttttcaaactcctggctctgaacggcagcgtctttttccttgcgaacttcatcgagtttctgctcaagctcttttaagttcggaggcgttgtgaaagaacggagacgcacttttgaaccggcttcatcaattaaatcgatcgctttatccggaaggaagcggtcagaaatataacggtcggacaatttaaccgcggcttcgatcgcttcatcggtaatggatacgcggtgatgcgcttcatagcggtcacggagcccttttaaaatttgaatgctttcatcggctgacggctgatccacctgaatcggctggaaacggcgctcgagagccgcgtctttttcgatatatttacggtattcatcaagcgttgtggcaccgatgcattgaagctctccgcgggccagtgaaggttttaaaatattcgatgcgtcaatcgcaccttctgctcccccgctccgatcagtgtatgcagttcgtcaatgaataaaataatattgccggcctgacgtatttcatccattacttttttcaagcggtcttcaaattctccgcggtatttcgtaccggctacaaccgtacccatgtctaacgtcattacgcgtttatcacgtaaaatttccggcacttcattattgatgatctgctgtgcgaggccttcagcaatcgcagttttacctacacccggttctccgataagaacgggattatttttcgttctgcggcttaatacctcaataacacgctgaatttctttgcttcgcccgataaccggatcaagactgtcttccttcgcaatcgcagttaaatcacgcgccagactgtcaagcgtcggcgtgtttgcattgctgttggtaccggatgcagaagaccccgtctcattgcttcccagaagctgcagcacttgctgtctcgctttatttaagctgacaccgagattattcagaactctcgccgccacgccttctccttcacggatcaatccgagaagtatgtgttctgttcccacataagaatgtcctagctttctggcttcatccatgctgagctcaatgactttttttgctcttggcgtataatgaatcgtttgagacatttcctgtccccgtccgattaagctctccacttctttctgaattttatccgaaccgagtccgagtgcttggagtgctttagccgcaatcccttctccttcacgaaccagacctaataagatatgttcagttccaatattgttatggcctaagcgcagtgcttcctcctgtgccagtgccaataccttttgagctcgctctgtaaaccttccaaacatcatatcgaatcatcctcctgtctatttgcactcatttctaaatgcagcctttccctgataagcgccgctcttctcgcgtctctttcgttcggccgtaatgcaccgcccgaatattgctggagaaaacccggctgtgtcaaaatcatcagttcattaagtatattgcttgatagccctttgatgatcccaaggtctatccccagccgaacgtcagaaaggcatttcgccgtttcctttgattcaatcatacggcagttggataaaacgccgtaagatctgaatacccggtcctccaattcaattttcgaagtttggtaaagcgcttctcgggctgaacgttcctgctcaatcagctgggcagccacactgtttaaatcatctacaatgtcctgttctgattttccgagtgtgatttgatttgaaatttgaaagatatttcctaatgcttcgctgccttcaccgtaaattcctctaacaactaagcctaattggttaattgccggtataattcgattcatttgcctagttaatacaagacccggcaaatgcatcatgactgaagcccttagtcccgtccctacatttgtaggacagcttgttaagtaccctctcttctctccaaaggcgtaatccactttctcctcaatccagtcatcaacctggtttgccgcttttatggcgttgagaagctggaagccggggaagaggcattgaattctgatatgatcttcttcatttaacataatgctgacttcttcattttcagaaagcagacagccgccaaaaggagattccgttaaattcgggctgatcagatgtttctccatcagcacccgtttttccaaaggctgagcttcactcattctgattaaatgaaattgaccgatatcaggcagttccttacctgaaaaatgatcttcgaattgctgaatgatggatgaggcttcttcattcgtataccgggcgggaaactttatattttcaaagtttcgggccaaccgtatacggctgctgagtacaatgtcactttcaggtcccttttgcttcatccaattgcttagtgcgtcctgaataaaatgcttgagcgacattacccttgttcccctcactgtctgtactttttaattcctgctctaacgatcggatctgatccctgacctccgctgctctttcaaactcttcgtggtgtattaaagattcaagttctttttttaacatttccatttgccgtcttacatgcaggtttccgcctattcgttttggaattttcccggcatgcaccgtattcccgctgtgaacttttcgcaagatcggcgtaatttggctgtagaacgtatcgtaacattccgcacagccgaaacgccctgtttttctcagctgctgaaacgtcataccgcatttcttacaagctgtgccttgctctgagtagccgaacatttgagaaccggtgttttgaaatgaggactccatattcagcagtcctgataataaattatgaattgagaacccttggtttccacttatactgtatgaatcgctattttcttttgcacattgttcacaaatatgaacttcttgcttttctccattaacaactttcgtaaagtgaaaagtggccggtctctcattgcattcttgacaaatcaatcttttcacccgcttactttagttttaaagatgtgagcattgctttcatcattctggctcttagttcatcccgttcgggcaaatcaatatatagaactgaacgatccattacactcaccatcattttagcttctctttccgaaataactccgtcctctaacagtctgagaataatgtcatcagaggctgcctgggacaagtgggtatggatctgcgaaataatattattgatgaggacgacttcgttattcattttaattttgataatacgaatataaccgccgcctccccgtttactttcaacaatatatcctctttcacttgtaaatctggtgttgatgacataatttatttgggaaggaacacattgaaatttatcagcgatttcactgcgtttgatctctaaaatttctttgccattttgatctaatacttgtttcaagtactgttcaatgatgtcagaaatattatgtcccactcaaccccctcctttattgactttgactatatttgactttaatcttactataaggtgtttcgcaaaatttttcaactgtatcgctctatctctattatttccactttacacaagcataaaacctgcttttgcaaaaagccatatcgttacttttctcatactatataacgtatgcagaaaaacacaaaaaaggcagctcatgatgagctgcctttaccgtaaatatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccatctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattacaattgaatgtgaattacttctgttatctagttttcaaagaacaacatctcgaagaatcgaatgatccttcaaaactaaacaagacagggaacgtactgtttataagacccgaggtctaatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgttcactttctcaagcaactttttaagtatataataagtttctcttaaagtcaacatgtttttttataaatggtggagcctagcgggatcgaaccgctgacctcctgcgtgcaaagcaggcgctctcccagctgagctaaggccccgaagtggtcgggaagacaggattcgaacctgcgaccccatggtcccaaaccatgtgctctaccaagctgagctacttcccgatttttaaaaatattatggcgcgcccgagaggagtcgaacccctaaccttttgatccgtagtcaaacgctctatccaattgagctacgggcgcataataatgaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcatacaggataactatcctgtataatgcgggtgaagggacttgaacccccacgtcataagacactagatcctaagtctagcgcgtctgccaattccgccacacccgcgttacatggtgagccatgaaggactcgaaccttcgaccctctgattaaaagtcagatgctctaccaactgagctaatggctctttttaaaagacttgtgttattatcttgtccaaaaatggtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatattacacttacgtgtaatggcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtcccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcaggaaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaatatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgtcacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgtctttcgttcaagcgactttattattatatcttatcaatctcttgaagtcaacaactttttaaatttctttttttcgtcagcgccttgtttagcggcaacgaataataatataccacctcacaaataatagtgcaatagtttttttaaagaaaatcaaaaagttttacgagcggcttgtttctaaaaaagcgccgtactgcgataagcagaaaacggcgccttcccttttattagcgttgtctcatttgagggaataataaaacgtctctgatagacggagcatttgttaacagcatgacaaggcggtcgataccgatacccaatcccccggtcggcggcatgccgtattcaagagcttcaacgaagtcttcatccatcatatgcgcttcatcgtttccttcttctctttcttttaattgcgcttcaaagcgttccctctggtcaatagggtcattcagctccgtaaacgcattagcgtgctcacggccgacgataaacagctcaaaacggtctgtaaagcgagggtcctccggatttttcttagcaagaggagaaatctctacagggtggccgtaaataaatgtaggctgaatgagtgtttcttcaattttttgttcgaagaattcattgatgatatgacccaccgtcatagagtttgtgatctcgataccatgctcttttgcatgaccgcgcgcttcttcaacagtcatctcattccagaaatctacgcctgtcgcttctttgaccgcatctaccatgtggagtcgtttccactcaggtttcagatcaatctgctcttcgccgtactggattgtggtgcttccaagcacttcctgcgcaatatgtgctacgaggttttccgtaagactcataatatctttataatcggcgtacgcttcatacagctcgatcatcgtgaattcagggttatggcgtgtagaaacaccttcgttacggaacacgcggccgatttcgtagactttttccaatccgccgacaatcaggcgtttcaggtgcagttcaatcgcaatacgcatataaagaggcatgtcgagcgcgttatggtgcgtgatgaacgggcgtgcagacgctcctcccggtatgctgtgcatcgtaggtgtttcaacttctaagtatccatggtcatctaagtatcttctcatcgcttggatgattttgctgcgtgtgataaacgtttgtttgctgtcagggtttacgatgagatcgagatagcgctggcggtaacgctgttcaacgtcttttaacccatgatatttatcaggaagaggacgcagtgcttttgtcagcagttcaaaagatgtcgctttgacagaaagctcgcctacgtttgttttgaaaactttcccggtgatgccgataacgtctccgaggtctgaagatttaaagatttcatattgttcttcgccgacactgtcttttcttacgtaaatttgaatttgaccttctaagtcctgcagatgcgcaaagccggctttcccttttccgcgctttgtcatcatacggcctgcaatggtcacttcgatcgctttttcttccagttcttctttagaaagctcctggtaggcgtcaatgatttgttgagattgatgcgttctctcgaaacgttcgccgaaagggtcaatgccgttttctctcagctggttcattttatctcgtctgacttgcagctggtcgttcaattcctcatgattttgctcttcttgactcattggtatcactccgttacattttgatttcacgaaaaagcagaaaaactgccagcggtaagctggcagtgagcagcaatagagggtgtatattaacctacttttgcatcttgaagctcttttgcctctgcttcggcggtaaatgcatctaaaagctgcacaaatttttcacgcgtctcacattggttaatttcattgcgtacattcgcattgcctctgacacctttcagataccaggcagcgtgttttctcatttctctgactgccacattttcgccttttaacttaatcaggcggtctaagtgcagtttgcataccgacattttttcacggactttcggctcgtcttttaactcaccggtttcaaggtactgcaccgtacggtaaatcatccacgggttgccgagtgcggcccggccgatcatgacgccgtcaactcctgtttcctcaagcatgcgtttcgcgtcctgaggcgttttgacatcaccgtttccgatgacgggaatggagacggattgcttcacttctttaatgatatcccagttcgcagtgccttcatacatttgcactcttgtgcggccgtgaagggcaacggcttttccgccggcacgttcaacggcttgggcgtttttcaccgcataaatgtgatcttcatcccaacccattctcatcttcactgtaaccggcttatcaacagcatctactactgcggataccatttcataaatcttatcaggatcgagaagccatttggcgcccgcatcacattttgtaatctttggtacgggacatcccatgttaatatcaataatatcagcagtcgtgttttgatctacaaacttcgccgcttccacaagggtttccttttttcctccaaaaatctgaaggctgagcggtttttcacgttcatcaatgtaaagcatccccattgttcttgcgttgttgtaaaggatcgctttgtcactgaccatttcagcgcataccaatccggctccgaattcctttacagtcaatctgaacgctgagttgcagacaccggccataggggcaagcacaacccggtttttcaattgaatatcaccgattttaaacatttttcccctcctttcatttgtctatttttcaggcggggccaattcgtccgcacttatatttaaaacatctgccgcatcttgaatgatggcatctgacggcaatcggtttccgcgttcaatttcaccgacaatagaaactgatatacctaatgcttttgcaaatccttcttgagtataacctttcagctttctgaatgcacgaattcgcctaccccagatttctgcttccatactcttacaccttcttggtttgtttcagcgcttatcgtgatatgatccgcctgcggacatatttcttttaacggcgcaaggacaaataagcgctcatacattctcggatgcggaacaatcagccgctctgtttcaatattttcacgattatacagcaaaatgtcaaggtctgccgtccgcggtccccagcgaatctctctcgttctgcctaattcagcttcaatggactgtgttacatctagaagttcaaaaggagataacgacgttttcacttcaaccgccatattgagaaactgatcctgatcctcataaccgacgggatctgtttcatatatagaggatatctttgacaccgtcacgccatcatgccgggtgagcatggccactgcctggcgcaaataatgttcacggtcgcccatattggaaccgaggccgatatatgccgtattgttcatgatttctttctcgtcatttctatggctactgatttataatggccgggaatcggcgggtcaggcttaacaacctttaccgtacattgctgcaccggctcaaatttctcaaggacggtgtctgcgatccgttccgcaagggtctcgaccaaattaacgggctcgccctcaacgatgccgcggcagacactgtacaattccgcatagttaatggtataagaaaggtcatccgtttttcccgctttgctcaaatccagttcggcagtcaggtctactttgaagcgctggccgagtttgttttcttcctcgaacacgccgtgatatccgtaaaactccataccttccacatatactttatccataatgcgcgcctcctttgttcagcatagcatccatcatcttagtcattcttgcgatctctttaacatcgtgcaccctcacaatgtcgcagcctttttggacgccaaggcatactgtcgctcccgttccctcggcacgttcttcagggggaaggtcaagcacacggccgatgaacctttttctcgatgtcgccaggagcagcggataccctaacccgctgaacacctccagcttgttcatgacagccagattgtcctcatagtttttcgcaaagccgatccccggatccagaatcatgttttcatctgtgacgccggcttctgcggcaatttttacgctttccatcaagtctgcaagcatatcaggaataagatcgttatagtttctttccatacgattatgcattaagataatcggaactccgtgtgcggcggctactgacgccatgtcagggtcacctttcgcccccagatgtcattaaggatagaggctcccgctttgaccgcttcgtctgccacggacgctttgtacgtatcgattgaaagcggaatgtccagctcgcttgtaatccgttctatgacggggatgactcgtgacatttcctcatcagccgaaacgagtgatgcgccgggccttgtcgattcgccgccgatatctatgatatgcgccccttcttcagccatcttcgccgcatgcagaagcgccctttccgtactgtcgtatttgccgccgtcagagaaggagtctggcgttacatttaatatccccataacgagcgtcttctctttataggacagagcgcctttttttgtatgaatcagtttaggctgttcaattgtttgctgcgccattttgttcctcctcctgtacattcattttgtttatttcctgccgatactgcttacggagcaattgcaccgttttcccgctcattccgggcagcggcacttcctctattttagaaaacgggatgatttcaagcacggagtttgtcaaccatgcttcatccgcttcaagcattgattgaaaacggaatcggccttcggtgacttctgtcccctgccgtttcaattcatcaatgacaaactgtcttgttacaccgtcgagaattcccgtatccaaagatggcgtaaagaccttgtctccttttcgccaaaacacgttggagacaatgccttccgcgacatctccttctccggtcaggaaaatcccttcaagattgggatcattcccgatctcccgtttagcgtacatgttgtttaaatagtgatgggattttaaccggaaagatccttcaggcgtatttctccggacagagagaagcctgccttctttttgaacaggcagagtttccggattgagccggttcacgaaacaaaggacggtcggcttttcataagtctgcgcggcaaatcccttatcgctgacgcctgccgagatgttaagccggacacgcgcgctgccgtcctttatgtcattgagaagcaacagtctccgaagcatatcaagcagctcctgtttgttcacctcgaatgcaatctgcagatcccgaagcgccctgttgagcctggcgacatgcgcatccggcagaaacggccggccgctgtaaagcctgaacgtctcgaacgctccgatcccgtacagataaccatggtcaaaaggagaaagcgccgcttctttctcctctatatattgaccattcaaatatataatcacaccgatacttcctttttgcggtgtgtctctataaagtttctgagcatctctttgccgaaggaggtcatgatggattccggatggaactgaacaccttcaacaggcagctcattatggcggatggccataatttctccttctttggtttgagcggataccgtaaaacaatccggcagcgtgtccgctttgacaataagtgaatggtaccgggtggcgaccagcggattttgcaggccgttaaaaatcgtctgtccgtcatgcataacttctgacgttttgccgtgcatgagccgctctgctctgacgacatcgccgccgaatacttgcgcaatcgactgatgcccgagacatacgccgaaaataggaatactgccggcaaaatgtttgatggcttcgaggctgatccccgcttcatcaggactgcacggcccgggagaaatcattaagaagtccggacccagctcttcaatctgctcaatcgtaatctcgtcattccgtctgacgatcagttcctccccgagctcacccaaatattgaaccaagttgtacgtaaatgaatcataattgtcaatcattaaaatcatctctgctcacctcgtctgattttttgtctcttcttcgctcagctctaacgcctttttcatcgcaaaagcttttttgaacgattccttgtattcatgcttcggaaccgaatcaataaccactcctgctccggactgcataaaagcatgtccgccggctgcatagatcgtccggatcacaatgttaaactgcaaatctccgttgaatccgaaccagcctatagatccagtataaagcccccgtcttgtcggctcaagctcttctataatttccatcgttctcactttgggcgctcccgtgatggtgccccccgggaacaccgcatgaataatgtctgtcgcgtcatatccgtcctgcagctctccctgtacgtttgacacgatatgcatgacgtgggaatatttttcgatcgccataaactcgttaacccgcacggagccgtagcgcgatacgcgcccgaggtcattacgctcaagatcaacaagcatgacgtgttccgcacgttctttttcgttgtgaattaattcatcagccaaagccttgtcttcagcatcgtcttttcctcttgaacgcgtacccgcgatcggtctcgtttcaagcttcttccccttctttgtcaccaatagctccggcgacccgcatatcacttgaaaccccggtgtctcgagataggccatgtaaggagacggattgacgtttcgcaagtgtttatacacctcatacggatgaacggataaagactgagactgcctgatggacaaattaacctggaacacatccccgctcgcgatatattgtttaatttgttctacagcctgtgaaaatccttcctcggtgaacggagcggcgtacgatccgtccccattccgattcagcggtgaaaaaggctcgtccgccgtttggagggaacaccacatgtcctctaagccggacagcttttcttccgcaagatccgcttcttccgcttcagtatgggtaatgagccataacgcctcttcctcatggtcataaacggccacatcatcaaaaacaagaaagtaaatatcaggtgtttccagatcatctaacgacagcatcttaaaattctcaatatatcgggcatagtcgtaactgataaaaccaatcgcaccgccctgaaagtccggaaactcaacgtttgtttccgttccgagcgttccaaaccattcatgaaaggcccgcagcgggtcaccttctttaaacagtgtttctccctcatgcttgatcgttgtaattccgtctttccctctgacggacgcaatcggatctagaccggctatactgaatcttccccctctcgcgctttcgagcagaacatgccgttttctcgatttcgaaaggttttcatatcgctgtaaaaatgcttgtttcgtaaaaggtatttttcttcctgccggtctgcgttgtgccatcatatcaatcctctgcttcgttttactgtagttttattttaaagcaatcacactggtgaaaaaagtgaatttcacttccaaccataaaattcgaaacgttttttggattttcgatacttcaggcacaaaaaaactcccggatacagccgggagccgtgtgtatgtctctattcaaactgataaagcggtgtgcttaagtaacgttctccgttactagggatgatcgcaagcactttcttgcctttcccgagttttttcgcgatttccagtgccgcgtaaatggccgctccggaagaaataccgccgagaatcccttcttcttttgccgttttacgggcatattcaaatgcatcctcgtttttgacgggaatgatttgatcatagatgtccgtattcaatgtttcagggacaaatcccgctccgataccctgaattttatgcggacccggttttccgccggaaagaactggagaatccgccggctctaccgcatagattttgatggatggatatgcttttttcagcacttcgcccgctcccgtgatggttccgccggtaccgattccggccacgaacgcatcaagctggtcgtcaccaaactgttctacgatttctttccccgtcgtttggcggtgaatttccgggtttgccgcattgttgaattgctgaggcacaaagtatccgtgttcctccgcaagttcttccgcctttttaatggcgcccttcattccttctgcgccgggagtcagcacaagctccgctccgtatgcgcgcagcagattgcgtcgttccatactcattgtatcaggcataacgagaatggctctgagacctttagccgctgccaccatcgcaagaccgattcctgtatttccgcttgtcggttcaatgattgtgtcgccggcttttaattttccttctttttcagccgcttcaatcatcgccgctccgatacggtcttttacgctgctgcccggattcatgtattcaagcttcagatatacatctgcactgttttcatccgtcaggcgattcaatttcacaataggagtatttccgattagttcagtaatagaatttgcaatacgcaccatgttggacacctcaatttccgactaaatttattggtattataaatataagttatcaatttcaaaattttttgtcaatcatttagttcttttttccccgtagaaccaagagacccccgcctctttccacagcgttttgactgtcgccttgtcacctaattgatccatcgcgatctggcgtctgatttgactcttcacttcattgtatgagaaagttctcgctttaagcttttctttcagctgaatgacggcatatcctgaagaaactttaatcggttcagcggaccattcatcttctttgagatttttagcttctgtgatatatgcctgcgggatattttcctggttttctgtcacaaagccgaggtctccgccatactgagacgtgtatctgtccgtggaacgctcagcggcgacggcttcaaagctggaaccgcctttcaaatcagcaagcaccctgtccgcctcttccttgtttttgacgacaatgtgcctgattctgtaggaatcatcgaaatggtacagttctttatttttattataaaatgattgcatttccttatccgatatatcgatgtccttcgtcagcagttcttcaagaagaatgttgtagcggatctggtctctccattctttttcggtaatatggctgtcttcataaaatgaattattcaccgctttgattaaaagaaattcacgttccaattcggtgtttgaaactgtgagtttattctttttcgcaagttcttccactacttgtgcattaatcatatcctccagagttgattttccgtactcgtcttccatctttttcatccagtcctgccgtgtgatatgtttatcaccgattgtcgcgatggattcttcagatgaccccgcggcttgggattttgttaacttatacgccactgctacactgcataccaacagcgccgctacaataatcgtcaaaagtgttctcgatttcaaaatctaccccatcccttttacaaaatagaacaacccgctaaagagctagcgggttgtttcgtcacgaagctcttccagttcttcttttgtaaataaatatttctcattacaaaaatggcaaaccgcttcggcttttccgtcttcttctatcatatcttgtatttcttttttgcctagtcctaaaatggccgtttcgaatcgatcttttgaacaagaacagtgaaatttgaccggcattgtttcgagaacgtccggtttttgacccagaacttcttctaagatttcttccggtgtcaggcctttttgaatcaattttgaaatcggttcgatttgagataattgcttttcaattgttgaaatggtttcttcatcagtccccggaagaagctgaatgatgaacccgcccgcagcgagaatcgtgttatcaggatttactagtacacctaccccgacagatgaagggacttgttcagaagaaacaaggtaatacgtgaagtcatcaccgagttcacccgagacaatctctacttgccccgtaaaataatcacgcaagcccaaatcttttacgacactgagtgttccgtcagttccgaccgcccgtctgacatccagtttcccttgttcattgaggtcaaaatgaacgtgcgggtttgatacgtatgctcttacctcaccctttgcgttcgcatctgcgacaatggctccgatcgggccgccgccttctattttgactgtcagcttatcttcacccttaagcatcgctccgagcatcagagacgctgtcatcgtccggccgattgcggctgatgccgtcggccacgtgtcatgccttctttgcgcttcatttaccatatctgtcgttctggctgcataagcccgcactttaccgtcatatgcaattgctttaattaaataatccatcgtttacctcctatatgtgacccacgcgatttcgctcataaatgatttccagcccttttaaagtaagaaacgggtcaacaatatcaatacagtctgattcgtttgcgattaatgacgcaagcccccctgtcgcaatgactttcggttcttgtttggcctgccatttcatccgctttacaatgccttcaacttgtccgacatagccgaaaaggatgccggactgcatggcgcttaccgtgtttttgccgatgatattatccggtcgggcgatttcaattctcggaagcttggccgcgcgtgagtacagcgcttccgttgaaattgtaatgccgggagcaatcgcaccgcccatgtattgtttgttttcatcaatgtagcaatacgtcgtcgccgttccgaaatcaacaacaattaaggggccgccatactgctggatcgctgcaacggcattgacgatcctgtcagctcccacttctttcggattgtcatattttatatttaaacctgttttcattcccgggccgacaacctgcggctcgatgtgaaagtattttgtgcacattctttctaaagagaacataatcggcggcactacggatgagatgataatcccttcaatctgttcaaacatcagtccggaatgttcaaataaggagcggagcagcatgccgaattcgtcttctgttttgtgcctgctcgtttctatgcgccaatgatattctaattccccatcatgatatacaccaatcacggtgttggtgttccccacatctataaccagtaacaacctctatcaccacttttgaatagtttctaatcataacattttcaacattctacaataccatacacgatctgcggctcttttgtaaacaaaacggaaccagtaaaaaaaccgccggtatacgccggcggttttcatatcagaaagcgaactattctttcggctcgtctttcttttcgtcttctgttttagacaggatgtttactttcacatcgtctttttgaagatggtcatctgagaaattgcgctcagggagttttccgtgatccacgagatgcttgatttgttccgcatctaatgtttccacatcaagcaatgtctgagcaatcaattcaagcttatcgcgattttcagtcaggatggttttcgcacgctcataacattctttaatgatgcgctgaatttcctgatcaatttcgtaagcgatctgatcactgtagttttgctcgttgttgaaatcccggcccaggaatacttgaccgccttgagattgaccgaactgaagcggtccgagtttttctgacataccgaactctgtcaccattcttctggcaatgttcgttgcccgctggaagtcattgtgagcccccgtgctgacttcgccgaagataatttcctcggcaacacgtccgcccagaagaccgacaattttatcgagaagttcaggttttgtctggaagtaacggtcttctctcggaagcatgactgcgtatccgcctgcctgccccctcggaacaatcgttactttatgaaccatatcggcttcatccagcacaagtccgataacggtgtgaccgccctcgtggtacgccacgatattgcgttcttttttcgagatgacgcggctcttcttcgcaggacccgcaatgacacggtccgttgcttcatcaatgtcgcgcatatcaattttcttcttgttttgacgggcagcaacgagtgccgcttcgttaagaaggttttctaaatctgcgcctgagaaaccgggtgttcttgaagcgattgcttttaagttcaccgtctcatcaagcggtttgtttctcgcatgcacctgcaatacggcttcacggccgatgacatccggacggtctaccgtaatctgacggtcaaaacgtcccggacggagcaatgcagggtcaagaatgtccgcacggtttgtcgcagcgataataatgattccttcattcgcactgaaaccgtccatctcaacaagcagctggttcagcgtctgttcgcgttcatcatgcccgccgccaagaccggcgccgcgctgacgtcctaccgcgtcgatctcatcaatgaagatcaggcaaggcgcattctttttcgcattttcgaataaatcacgcacacgggaagcaccgacaccgacaaacatttcaacgaagtcagatccgctgatgctgaagaaaggaacgccagcttcaccggctgaggctctcgcaagcaatgtcttaccggttcccggaggtccgacaagcagcacgcctttagggatcctggcgccaagctcggcgaatttgcggggatctttcagaaactcaacaacctcaacgagctcctgcttctcctcatccgcgccggctacatctttaaacttcacgcgtttcttttcttccgtatacagcttcgctttgctctttccgaagttcatgacacggctgccgccgccctgagcctgattgagcaggaagaaaaacagaataaagatgatgacaaacggaatgatcgtcgttaagaacgtcacccacccgcttgtttcctgtgcgggatcaacttttacgtccgtctttttaattgcgtcaaatatctggtctgctccttttccttcaggaacatgtgttaaaaagtactggtctttgtcgtattttttcagctgtccttttacctcataaacacctctgacaggctgaaccgatacgctatcaactttcccttcatcgaggttcttgataaacgtactgtacgacatattttctgttttcgggtttgaggtctggaagtaactcacaaccccgattactactaataaaataagtaaataaaaaatggtattacggaagacccgattcattccttacctcctcccacagtaagcacaactatgttcaatagtaccatagaaaatcattccaatacaaccgataaccatctcggaagcaggcagccgatcagctttcataaatcgccggttttaatactccgatgtaaggcagattgcgatagcgctcggcataatcaagtccgtaacccacaacaaacgcgtcaggaacttcaaagcctacgaagtctgctttaatgtccgcttttcttccgcttggtttatccaacagggtaacaatcttaattgatttcgctttacgatatcggaagagttctacgagatagctcaaggttaacccactgtcgataatatcttcaatgattaagatgtcccggccttctacagatgtatccaaatctttgatgattttgacttctccggaagaaaccgtggaatttccgtagcttgatacatccatgaagtccatttccaaatatgtatcaatatgctttataagatcagccataaaaggaagcgctccctttaacacaccgattgccaacggaaacgtgtcgctgtactcgcttgttaattgttctccaagctgttttactttctgctggatctcatcttctgagatcagcactttttcgatatcctgtttcatgttaatgcttgccccctacacttttcatgctgtctatattgtaatacaatgcggtcactgtttgaaatcacaagatcgtcaaagatggattttttcaagccaggcagccagataatttcaccgctcgcatccgttacaatcggccattcgtcccgatcccgcagaggcagtttatgatcaataaatatatcttttacctttttcgagccattcatccctttaagtttaatccggtcgccgatttttctcgtccggattgttaaaggaaattgcaccttatttctgcttgtcataaaaacagcattcccatttttgatatgagggtcagcctgatcggccacctctatcataaagccgttggggagaacagcagtctcgccttccgctccttgcagctgcagctcaaagggaaccttttcacattgccattgttcaaatgtaaacaaacatgtctgatatgatttgaccaccttcagccctttcggaaaatcaagcactcccgaggcgcttccattttccgcccattccagaaactgctgtatgtggcgggcggaaaacgacgatggaacgttttcataaagatagtttaatattagttgaactcctcttctttgtaaaggtatcggaagggcaagcaattgagaggaatcgacttcaaccgatgtgtcagacttgcttgtaataaccttattcattcgttctttcgttaatgactgcaagtattgttcgtcttctgtcagtgcttcactcaccttttgaaacattttatgaacgtcaggtgattcttgttttaaaaaaggaagcacggtctttctgaatctgtttcttgtataatcgtcttttgcattgctctcatccgttctgtagctgagcccttcttgacggcagtattctaggatttcatccttttccgcatagaggaaaggcctgatcagccagccggatgcaaattcgcggacgggctgcattcccgcgagccctgcgccgagcgtacctttcgcaagcctcatgagcattgtctcaacctggtcatcgccgtgatgagccagcgccaaaaacttcgcttggtgttttgtcatcagatcttcgaaaaactgatatctgcaatcacgcgcggcagcctgcttgttcagcttattcttctttgcgtatgcagaaacatcaatctgtaccgtttcgcagaggatgtgttccgcttcgcaatatgactgcacaaacttcatatcttcttcagattcaggacccctgaactgatggtcgacatgcgccgctatgataacggaagaatgcccgaagtgcttattcagcatactgagaagcgccattgaatcagggcctccggagaccccggcaataatcgtttctccctccgcctgaagatgatatgttttgaaaaaatcttccacgcttttcacaatgtcccctcacaatgagcaggtttttttaaagatatacatatcctatcactttcattccctccaagcaaagaagaagcatgagcgcaggcgtccggccggcattagatgagaaaaaagacgatgtaagcgaaataaagggcgagaacgctgattaaaataagcgttgtttcaaacaaaccattgtgctttgcgggtttttgtttaggtttataccgcgtttgagatacagtgccctgccgcggttttgattgcggcggcttaggcttggcggcggctttccttttactcccggcgctctgccccgccgtcaggatgtcatgcttcatggcttccgcagacggatattggccgtttaaagcagaaaacagaaccttcttatacttattcagaaacgggtggccttcaatgatagaacgaagctgttctttcggctgtcctgactttttgcactctttcttctggacacagtggatcatgatcattgcgacagcaaacaggtcataggatggttctgcttttcttgttccatacccccaatagccctgtcgtaaaactccgtatactctttaatcgcgcggccttgttttgtcgttccccctacatcaatgcagcggatggcagccggcggtccggttacaataagattttccggtttgaggtcgccaaaaacccatccctgctgatgaaggactgacaagctggaaagaagctgcaccatcagcaccggaatccactccgctcccttactgctgatatattgcggaagaagcggcccttctatgtactccatcacgtaaaaagagacatttttattcagctgcggaataaacgcatcgtccgcatcaaaaaaagaaggccccatcgtttgcgaccgggcctttgaaaaggattttaagacattcacttcagaggtaacagacatgctgtcgctgcttattttcaaagcgacctgtccgcctgatgcttctgccagatatacaataccgttagccccttttccaagctgtttgagcaatctgtaggatttgccgttccatttgccctgaattgccgtccccggtgccagactacatgccaaactcgttaaagcgtcgttcatcatctgccaacatgctccttcttgagcggattctctcaaactgctgcgtcgcttcccggatagcggggcccgtaggggtgataccgccggtcgacagcttcgcaaagagcgcagaaagggattcaagcttcggcgtccaattcagcacaagctcaacttcctggcttttcccgggaaatatacacatggcaaattcattttgtccggcccgggaatttaaactgatggaaagatcaatcagcgcttctttcaccgtcggcagtttcggcgccatactcgcactcgtatcaaccagcacaagcacctgcagatgaactgtttctccgagttcatcaaccacttccatcacttcgccgcgtttttccggagaaagctcttccatttcaacgtttttccctaagatttgtttaagctcttgattgacgacaccttgcagcgtctgggtcattgcttttttcgtcaccatttgaaccgtctgagacaattgtgacgcatatacaacttgatggacgccgccaccggccatggcgatgccttcaacttccttcattgcctcttggtcaatcgcgttttcttccataatccctataacattcaccgtaatcccctgctccttggcgaaagccgccattgcaatcgggtcttcaccatgattggagcagccatctgtaatcagcagaacttgatttaaatgtcccttattcacatacattcctcccggtgatacgattagtcccatcttcgccagaaggaaagtgatttatacgaaaggattaagaaatctcctttttattttggaataccgccggcaccggtatggaagcccatttcggcgtgttgtgatcaatccggacaacaaccaccgtcatatcgtcttcgatttggccggaacgcgttctgatgacctcttccattaatatatcagcgatttcctgcggatcttcggttttcagccctttcattttccgtttcatccacaggtcgtggttttcaacgtgcttcggtccttcaaaaataccgtcactcatcatgacgagcagatctcccgcttttaactgttcacttacaacctccacatcaaattcattgatgataccgatcggcagattgctggcctgcactttcatgacttgatctccccgcttgataaaactcggcgttgaaccgacctttaagaatttgcagcttgcatcctgaagatcaatgatagaaagatcgagagttgagtagatttcgtctgtcgtccgtaaagacagaatactgttgatcgttttgatcgctattttttcatcaatacctgattcgagaattttttcgagcagcttaatcgtttcgttgctctcataatgagccctcgccccattgcccatgccgtcactgattgcggccgcatattttctcgcccccagttccatcatgctgtagctgtcgccggagacaaggccgccgccttttgccgcatgagccgcgcctgtcgatacccggtacgatttggtcgaaccgaacgcaacatggctgtagccattcggatgagccgagtgctgttcgcttttgacaagtatctgctcctcaagaatgtcagacagcatcggggcgataattttctcactctcgccgtgtcctccgctgaacgggattgtcatttcgatatcaatattgccctgctccaagctgtatatctcgacatgctgaatctcgattccgaaatgctgaagcgcctctatcatttgttcttcctgaataaaatgctgctccctctcccgttttatttcccgagaaaagtccgccataacctcagaaacccccaacagctgctcggcaacaagcctcctgctgtcctgaacttttctcttcagtgtcagatgggcgtgatggtgggcaagttcgtcctcaatcagctcttccacctgtctggatttggaacagtgctgttgaaactcttttttcaatctgcggtttgaggcatactgcttttcttctgtttcatgcataacttgtttcattaagtcatatgttttatcaaagttttgaacccagcatttgctttttttatagcaggattggcaggaatgctcggtgattttgcttaaaaagagatccacttccccttcttccgcctgctcatcggaagacgtctgatgaaaggtggcgaagctctccgacaaggcatgaaacacattggagaactggtctactttctgggcggtgacatctctgattttcctcgcgtactgctgctgctcctgactgtgctcagcagtgcccggtatgtatcgcgccacctttttcgtaatcgattggggcgtaatcaaaaacaatacaacggcaatcaaagattcataaagagtggtcattaatccggcagacccttcaccatataatgaaatcagcagtgagccgatcaccaatccgactgcggcgccggctttctttccttctttcagcagcccgccaagaagcccggaaaacgcaagcagactcatttgatagagattcccgatattcgcaagcccgaggatcagtccggtcacaacaccgaccgtacagccgatgcttgccccgccgacaaaggaaaaactcagcacgacatagcgggccaggatatgttcagcctgcattccctgaaatgaaacaccggcaagcccggttaaaacggatgcgatcaagatcataaaacagatgatttcttctatttttaacgattgcttcacttttttgatcgtgaaaatcggcaggctttgtaaaaagatcagcgtcaaaataaaggccaggcccgcctcgacaacagccatcacataatcataggtggtaaaagcgccgctttcaaaataaacaaatccgattctcgcggcagccatagagaaaaacaccacgatcggcagcatcttcacccggtcctgcacgatatatgtaccgatttttgaaaatagagtgaagacggccaaagctgtgagaatcaataaagagtgtttcggcgaaatggttaaagcgcccgcaagtaaagacagacaagcatagaaggctttatctcttctgatcaaaagcatcgctccgaaaaacggcagtgcaaatggaagaacctcagataatatgaaagcccgtccaagtaaaaaaccgatcacgacataaatgaaacccttatagaaaaaaagtgaatgcgcttgatggactgtaagctttgccgccttttcaaaaaacgattgcagtttttccagagcttgtcccgccatcggcccgttcactcttctttccgctttttccattgctctcatcccccacctgttttattcgttgcttgtcattataaatgaaagcccagataggattttgtcaaaagaaggtaacaattccaaagaactcttcgacgctttctcccttgttcccctttccttttgtatttcctccgacatttctcaaaaagttgtctaaatatgaaaaaatcggcttctgcaacagaagccgattcgcttgatgacccgtacgggattcgaacccgtgttaccgccgtgaaagggcggtgtcttaaccgcttgaccaacgggccagatatatatggtagcggcggaggggatcgaacccccgacctcacgggtatgaaccgtacgctctagccagctgagctacaccgccatataggtgcttataagcacaagttatataatacaaaggtttcttcattccgtcaacagaaactttaaagttttaattttctgactacatgcgcgtatacaaaaaaagcacccgctgggatagacggatgctccatgtatttatagaaagcagcaagttatcctcttcttgctccgcgccctccacgttttgattccgtgtttcgttttaaagatgataagcggtcttcgctatctttaagaaacttgttcattttctgttcaaaagattctttcggacggaaatcatttctaggtctggcttgcggacggtctttagcttttttaattgataaaccaattttcccgtctttttcaacgttgatgactttcacttcaacttgatcgccgacttttaaatgctcgttaatgtcttttacataattatcggctacctcactgatatgaacgagaccggttgagcctccaggcaattcaacaaatgctccgaaatttgtaatacctgttattttcccttgcaacttgctgccaacttcaatcgacataaaaaaagtgctcctccttaggcttataaaaagatcgtttgtttaattatacctaaataaaaatttaagtgtcaacaaggctacttgctcttcttttctacattaaagagaatctcaccatttcctgacataaacaagtctcttctggcaagctctgtgacgtaatcctcatcctttaatttggaaatttcatcttttaaatcagcctgtttcgcattcaattctttaacttgtttttccagctgagcctttttttcttcgtttgcgctaagggaagaggtctgtgaccacagagaacccgctaagacaatagccgtcaacaacacaagggcgccgaatacgatcaaccgtctgaaaagccctttccgccttcttttcataagctgggattgccgttcaacctgctctttatagtcgttttgaatttcagttattgtacgttccctagatagattcaaaccagacggtcctcctttcaccttttcaaaatacgtatcatggtcgatctgattgttatgattagtttcttgctcttttgtaaaaatcctgcacttttttgaaaatatcgtttgaaagtaagacgccacttttcaggaagaagtttcaataattgtttcaacaggaaaaacagcggatacagcaaaaacgctacgatcttaaaaagacacttcgcaaaaaaggcactcacccgataggagtataaagaaataaccgtgatcagcccgatgagcagcttaaagagcagaagcaccggacggaacagcacgtgctgaatgagcttttttgcgaattggtaaagagacaccgcaagatgaatggcaaatttcagtatttttatatacattcgtttaaacaggctttggtacgtcgcaatacccagtaagacagccaagaaaatgtataccctgagttccccttcattcacgttgagcagcacatagaaaaacagcagaccttgtacaatccaaaagagaatgtcatgaatgaataacagccatctggccgttttggcgcggctgacaaacagcctgtatgtatcaagcgacgctccgagccaggcgcccataccggtcattgccagcatcgtataaaattgggtcgtcagcgtcatttaaacaacttgctaaaaaaccctttagctttatccccttgctgctcgtctaaatatacaaggtcaaacaccctgccttttatagatacaatccctttttccacatcaaggtttttcatctgcagattctcgcctctgacggaaagcattcccataaccgtttccagcaaaaactcttcgttatcaaaactttccacatgcttgacgcccgaaatgtctaaatgctttctccctttcatcgttacatcatgctgttccggaacagaagaagaacctttttgctcataatatgaattcatctattcagcccccatatcctcgatacttttagcattattactgcattgtatgaggcgggagccttgtttagaacaagcctattcgccgagtttttcttctttgacgattgtatacatgcccgcggcttcttcttttttcgttgtttctttcaattcatttaccttcacggtgacaagcttctgcccgaagcggaccttcagttcatcaccggcttttacgtctgagctggctttcgcctgattcccgttaacggtgattctcccttgatcggcgacctctttcgccaatgtgcgtcgcttaattaatctggatacttttaaaaatttatcaagtctcatatcagaatctcctctccatttcttttgcttcatcccacaatttgtccatttcctcaagtgacattgcggtcaattcaaggccctttgctgccgcttctttctcaatataagcaaagcgtctgcggaatttgtcatttgtcatggcgagcgcttcctcaggctcaattttatagtatcggccgatattgaccaatgcaaataaaacatcgccgaattcagcttttaagctgatttcatctgctgattcggcggaagcctctgcagaaaattccttcagctcttcatttactttatcccatatgtcctgaacgttatcccagtcaaagccggtttttgcggcttttttctgaagcttggcggctttcgcaagagaaggcagtgttttcggcacggcatccagcaatgaagaggatgttgtttgcttttccgcctttttgatttcttcccagttggcgacgacatcatgttcatcctgaaccttaacatccttaaacacatgcgggtgccgtctgaccatcttcgcactgatgtctctgatgacatcatcaattgagaaatacccctcgtcttctccgatctgggcgtgcagcataacctgaagcatgacgtccccgagttcttctatcatgtgatccgtgtcctcttcgtcaatggcctcaagcagttcgtagcattcctcaatcatatatttctttaatgactggtgtgtctgcttttgatcccacggacagccgttcggcccgcgaagctcgcgaataatacttcggaatgcagaaaattcctggtaaaggagttcttcttttttaatcggcggaacatacacgcttgttaagttatttatttctacattgcggtcaagttcaaacaaaggcaccttgatcatcttttctcccttgctcccggctgctgtaacgatgaccacttcatagtcgtcaggcaatttctccatgagcgtcagcttcacctcagaggccgtcatttggtcataaacctggcagatgatcaggtgatgccggagttcgagctcatccggcgtcattgtttgcgcatccgtaaattgaaacccttcaatcggatcaattcgcaacgcattaaaagtggcatccagaaagctttgccctccagcggtatgaacatctatctgttgttcttcccggcgttcaaataacagctgaacggttttctcagcgacaaacggatgcccgggtacagcgtagacgacatcctcttgcttcgctttttcaaacagaatgtccgcgatctcttcatagaccgcttcaaactgatcatgtttttcataaatatcatcaaaataccggatgtccgcttccgtctcttgctctaattccgaaatcaaagggtggtctttcgttcttatatataaatgcttcgcctgagtcagcagcttatgtacgcccactgtcaactgatccatgtctccggcgccgaggccgacgaccgtaatattacctgccatgtttttctctcctctttttcaatttgcttaaagcactgccgaaaggaagaccgctcagctcttcgtccgtgaaaatcttcattcttatcatacaataaataaacaatagccctccgatgattgacgcagacagactctcacatacagctccgcccctgctgacaggaacaaataactgccaaagcttcatgtatacgaccaaaaagaagaccatcagcagactgcaccagcacagacgggcaatcacgcctccgatattcgtcagccatcccttcgaccaaattctccggagattcaggcacgcaactgcggcaaatgccaagacggtcgccagtgccgctcctgtaataccccagccggggaccagccaaacattcagcacccatttcagcgcccctcccgccaaaacggatacggcggggaaaacggtatgtcccgctccttgcagaattgcggctgccgtaagcgcaatcgaggcaaaaaagatagataagctgaatatttgtaaggtcggcgtcccctcactgttttggaaaagcatgatattcaccggttctaaaatgcaaaaaagcccggctgatgcaccgatccctaccgcaaggcagagcttgacggcagatgacgctttctcttttatgataaacggcttgttctcatgcaccgcttttgaaattgaaggaaccaaggacgcggcgatactgacggcaaacacggttcccagctgaaggagcggctgtccgcggtcatatatgcctttcagctgtttcgcggcatggctctccgtcccgtctgaaagcagtgaatataagtttaaggcgtctacaagctgaatcaaaagcatgagtacactgctgatacagatggtgactgaataaagcagcagcttttttacaatgacggccgtttcgatatgtccgccgtctttctttgtttcttcccgcttataccagaaaacagccaatacacaaagggccgcaaagctcccggcaattgatcccgaggccgcccccgcacccgccgcgtataatgaacgcccgcttttcaaaagccagaaggataaaccgagaagcaccgccacccgaagaagctgttccgtaatctgggataaggctgacggcatcatatcatgcacgccttggaaatacccccggaaaaccgccgtaaacggaaacagtatgaaagcgaacgccgcgacccttatcagcatcacaaggcgggcatcacccataaaaccggccaacggcgccgcgccggcatacatgagcgcaaacagaacaagtccggccgccgtgacataaagggcggaaattttcattattttttgtttatgatcgctataatcgttcattaattttgagatgatcaccggaaaaccggatgttgacagcatgaccgcgatccctaaaaacggatacacctgctgataaatgtaaaatccgacgtcaccgacaatattctgaaaaggaaccctgtacacggcgcttaatatcttcgtcacgatgcccgcaacgacgagcacaaaagcacctttccatgccgattgccgcttggcgccaactgaatcgttcatccaaaagctccttccagccgctagaaaattacgtctataaaacgagcttattatatcacaatcctaacggccgaaccgatagagagcacatatgaatatgaaaaagaacagcacttgtataagagctgttctttccccgttttcttatttcaataatggtaataagacctactgctccatttgtctcgccaaaaaactggctgccgtttctaccgctttatgttctacttctccaagcgcctgttccttggaaaagatgaccacggcaccgataggatcgccatttgccacgatcggagcgattgtataggagctcatatcttcatcaatgtcattcacaagctgcgcggacttcacgtcgttttctaccactgagctgcgctgatccatcgttttttcgagcaaatcgctgatggctttattcagaaattcttttttcgaactgcccgaaacggcaatatacgcgtcacggtcgcaaatcaagacggaatggccgagactgtcatacaatgcatctgcatattctttcgcaaaatcgccaagctcactgataggagaatattttttcaatataacttctccgtcgcggtcaacgaatatttcaagcgggtctccttccctgattcgcagtgttctccgaatttctttaggaatgacgacccgtcctagatcatcaatacgacgtacgatacctgtagctttcatctctctggtgcctctctttcatgtgatgatatttaagggaaagtactaaagctctttactttatgtagcttccgccactcgcttgaaattagtatccgtcacatcaaatgtaatatacaccagagagtaacaatttttatgaagacgcgattgtttctttcttcacattctgaaggcctttcagcatgccgagcacggtctccagccactcttccgttttgcggcctttcgtctgtactgagattttcagctttttcccttccattcccagtccgatctgccggccgtatttattgccgagttcgaataatttctggccgtcaatctgtgcgctggcctcttcagaaatggtaaatctgatcgcgtctttatcctgcttgatgagttcgacgcgttcatattttccgtataccttcatctcagcaaccgtaaacagccattcaacttctttaggatagctgccgaacctgtcgatgatttcatcttggagctcatttttctcctcaattgtggcgattgatctgaagcgtttatacatgtcgattttttgcttgccgtcttgtatatagttttcaggaatatacgcgtcaagctcgatatcgatttctgtctcaaactgttcgcttttcggaatatcgcctttccgctcttcaatcgcttccttgagcatttgcgagtacaggtcaaaaccgactgagtcgataaagccgtgctgctgggcgccgagaaggttccccgctcccctgatcgtcaagtcacgcatggcgattttaaagcctgatcccagctcggtaaattctttaatcgcctgcagccgtttttccgccacctcagtaagcactttgtctctgcggtacgtaaaataagcgtaagcgacgcggttggaacggccgacccgtcctctcagctgatacagctgagacagccccattttgtctccgtcgaacacaatcaaggtattgacatttggtatatctacgcctgtctcaataatagtcgtgctgacaaggacgtctgattccccttccagaaaattgagcatgacgctttccaattcattttcggtcatttttccgtgggcatatgccacttttgcatcgggaacaagcatggaaatttcatcagccttccgctcgatgtcatccacgcggttgtacaggaaatatacctgtcctccgcgcgccagttctctttcgatagcttctcgtacaagcgcgccgttgtattccacgacatatgtctgaacagggaaacggttttccggcggcgtttcaataacggataaatcccgcacaccgagcatggacatatgaagcgtacgcggaatcggcgtcgctgtaagagtcagtacatcgacattggctttgatctgtttgattttttccttatgcgttacgccgaagcgctgctcttcatcaatgatgagcaagccgagatctttatagacgacgtctttagataagagcctgtgggttccgattacgatgtctaccgttccgtttttcagtcctttaatcgtttcattggattcttttctcgttctgaatcggctgagaagaccgatgttaatcggatagtcctgaaaacgctccgtaatggtttcataatgctgctgcgcgagtattgtcgtcggcacaagaagcgcgacctgctttccgtctgcgatcgctttaaaggccgctcggatggctacctccgtcttcccgtaacccacatcgccgcaaagcaaacggtccatcgggcgttctctttccatatcctttttaatctcctgaatggaacggagctggtcctctgtttcctggtaagggaaagcagattcgaactgccgctgcatttcatgatcgggcgagaacgcatagcctttgcttgcttcccgttccgcataaagcttaatcagatcatcggcaatatcctgaacggagttttcaacttttttcttcacccgtttccattcactgccgcccagtttataaagcttcggttcttttccttcagagccgacatacttctgcacctgatcgatttgttctacagggacatacagcttatcgctgccctgataatgaatgttgaggtaatctttatgaatgcctttgatttccagtgtttcgatccccaagtacttaccgatcccgtggttgacgtggacgacatagtcaccgacctgaagctcggaatagcttttgatccgttcggcatttgtcagcttctgctttctcggctttttcttgattcggtttttgaacagctcttcctccgtaatgacggccagcttcatcagcggcagttcaaaaccggattgcagctcgccttccatgacatagacctgtccttgcacaagcgctttggagctgtccgttttcgcggcttcaatttcgtaatcagccagcacggatgccaatctgtcggttctgtccttatttgcgcctaaaaagacgacggtgaagtttgatttcttaaagcgctccatttcacctgagaggacattcatctgcccgtgaaaactctgcatctgccggcttgtcacattcacgatattctgagggcttgtatgctggacatgacgcaaaaataatgaataataaatagccgggcgccgcttttcgctcataagctcctgaaagctgaaggataaatgaatgtcatgcagaattttcccttcctcgagcagacttgtcgtaaattcggcctcttctttttgcagctgatcctccatttcatgaatgcggctgacctcgtctaacaataacaacgtgtctgccggtgtataatctagcaaactagcaggtttttcgtaaaagtacgagagatacttcacaagttcctgatcagtctgtcccgttgataaccgttctttatcatgtgagatattgatatgaagcatttccttttgtttgtcctgcttcagctttttcagactgtcggcaagccctttatcgagcctttccattgcccgggctttttcttccgccctgatgatcaattccttcgccggtccgatcgccacatgtttgagcgtctcgattgatctctggtcatcagaattgaagcttctgatggaatcgacctccgtatcaaacagttcaattcgcaccggatgctccgacgtcagcggataaatgtcgataattccgccgcgaatactgaattcaccgggtgcagaaaccatatcggaacgctcataccccacctctacaaggcgcgcggacagctgatccggttctatatcgtctccgagtgaaatgacgagctggctgcttttccacagctccttcggcggaagcattcttctcactgccgcaacgggcgccacaacgaccggcgcttctccgtttgttaatctattaatgacatcaagccgctgagcgcgcagttcaggactcgctaccgcaatttctgaagaaatcaattcattcacggggtataaaaaaacagattgatccccgagaagcgccgtcagatcttccgtcactttttgggcctgatataaattatgggtgataaagaaaatcggccttttcgtttcctgtgcaagggcggaggtaaaaacagaacgcgcggaacctgacagacccgcaagcagctgttccttcagcccctcatgtaaaccgttgacaatggatttaaaatcatcgctttctttaataaaggtttgaatgttgtccatatgggccctcctctctattttctgcaagaacagaaaaacgctttggtctagaatctacaccaaagcttcttattgaataaatgtgttgtgttcatggtagtgcggattgcgttccagcgcctcttggcagtcttcacaaattgtaagaacatggacatctccattgtctttatatgaaatcatatcgtttctttcctcatttgttaagtgctgaaatccaagtgactgtgtcggcaccgttgaatattccaggctccctaccttaaagccgcagtggcggcagaaataatgcaaagccatacgttggacctcctgatgtgaaaaaatcatttttccctagtatggtctcccattatttatcttatacatttgcattaaattcgttcatgacttctaaaaatggtttcgttaaggaagcttcgcaggcttttacggtttttgagacggcatcattgatatgcggcgcttcttccttcgtaaaagctcccagtacatagtcaacgactttcattccgttaacggggcggccgattccgattctgacccggtcaaattcaggggttccgaggtgctgtataagcgatttaattccgttatgtccccctgcgctccccttcgtccgaagcctgatttttcccgtcggaagatcaaggtcatcgtatatgactttcagatcttcatgatcggcatcataataatccagcagcggccgcaaacattctcctgataaattcatatatgtaagcggtttaacaagtagaactttttttccggaaacaaaccccattccgtaaagtccgttgaatttcgttttattcagttcaatattccattctttagaaagctcgtcaatggccataaagccgacattatgcctcgtgttctcataggtttttcccgggttaccgagaccggcaatcacaagcatcgtaaatcctccctcaacatcgctgtaattcttctcattctagcacaaaagacgtaacctcgggcgggttacgtcttaaagcgcttattgattttctccttcgggctcttcctcaggagacggttctgcatcttcttcgaatgcttcctgcttaggaggaaggatggaagccacgacttcttccgggtcgtttgtaaatgtataattgccgtcagcagtcagatctgcgatggtcagcacatcattcatttcaagcccggaaatatcaacattaattgtctgagggatgtccttcggcttagccttgatcgaaagctcatgcagcggctgctggataacgcctccgtctttgactcctttcgcctctcccgtcagctgaatcggcacctcggcctcgagctcctcactcatattcacgacttgaaaatcggcgtgcgtcaattcgtttttgagcgggtctgtctgaagatcagtcaccataaccgattgctgatttccgttgacatcaattgtgataatcgtgttttttccttcgtcccgcaatgttttaagcaattcgacactgtctaaagagacaggcgtattcgttatttctttaccgtatataatccctggaacatgtcctgaatgacggattttccgaagcgtcgaacgtttaaaatctgttctttcatttgcttttaaagttgccatattcagcaccatcctaattatcgttttatcgtcctattagaacaatacccacaataactgggatttaaaccttaaagtttcggtttagctgaataaatagctgacagattgtttctcgtgaacgcggataatcgcttcagccagaagcggtccgacagaaagctgcttaaagcggtcgatttttttctcatcaggaagcttaatgctgttcgttacgacaagctccttgattttagagttattgatccgctcaacggcagggcctgacaatacagggtgcgtacagcatgcatacacttctgcagctccgttttcaaccagcgcgttagcggcaagtgtgattgtgccggccgtatcaataatatcatcgatcagaatcgctgtttttccttccacgttaccgacgatgttcatcacttctacctcattcggtctaggacggcgtttgtcgataatcgcgatcggcgctttcagacggtccgcaagtttgcgggcgcgcgtcacaccgccgtggtcaggagaaacaataacgatatctttcaagtctttaccttcaaagtaatggcctaaaatcggaacacccattaagtggtcaatcggaatatcaaagaaaccttgaatttgcggcgcgtgtaaatcaagcgcaatcacgcgtgtcgcacccgctgtttcaagcaggtttgcaaaaagttttgccgtaatcggttcacgtgatcttgcttttctgtcctggcgcgcataaccgtagtacggaatcacaatgttgattgttttcgcggaagcgcgctttagagcgtcaaccataatcagcaattccataatgtgctcattaaccggcgcacttgtagactgaatgatatagcaatcacagccgcgaatactttcttctatgttgatctggacctctccgtcactgaatcttgtaacagagcactttcctaattgaacccctacattatccgcgatttcttttgcaagttctggatttgaattcaaagaaaaaatctttaaattcttatctccgtattcgttagacatggtaaacctccgattttaggattattttttatgaatatttttcacataatcttctttatttacttgtcttgctctggcaatggcaagcgcttcgcccggcacatcttcagttacggttgaacccgcagcgacatacgcgccttctcccactgtgacaggagcgaccagattggagttgcagcctataaaagcgccgtcttcaatcttggttaaatattttttcttcccatcataattgaccgtgatggagccgcagcccagattcacatccgtgcccacttcggcatcaccgatatagcttaaatgagatgctttgcttcggtcgccgaattgtgttttcttgatttcaacaaagtttccgatcttcacttcattgccgattgcggaatcgggtctgatgtgagcaaaaggaccgatatttacatcattcccaactttgctgcggttgacaacggattgtttaatcacagtgcggctgccgattgaactgtcctctatctcagtgtgagggccgatgacacattcatcgccgatttcagcttgtccctttaacacagttccgggataaataactgtatcttgtccgatacgcgcgtcaggtgagatgtacgtattcatcggatcgattaaagtgactccgttctgcatatgccgtttgttaatacgctctttcatatacatttcagcctgagaaagagcgactctatcattcactccgagcgtctcttggaagttaccagtctggtaagcggcaacagtttcgccttcgtctttgaggatttcgatcacatccggcagataatactcgccttgggcattttcattcgaaacctgttcgatgacacgaaaaagagcctcgttatcaaaacagtacgttcccgtgttgatttctttcacaagacgttcttgctccgaagcatccttgtgctccacgattttttgaacggcgccgtcttcactgcggatgattcttccgtatccggcgggatcgtcggcaacggccgttaacaccgtggcttttgcacctttgtctgtatgttcattcagcatggcttccatcgtctccgccgtcagaagcggtgtatcgccgcaaataacgatcgtgacacccttttctccgtgaagaaatggttttgcctgcttgaccgcatgagccgtaccgagctgttctgcttggagagcgtaatcgcttttctgtccgagctgcttcttcacatcttcggcgccgtgtcctacgatggtgacaagcttcgctaaagataatttcagagcttcgtctgcgacgtgctctaccataggctttccgcataccggatgaaggaccttataaagcttcgatttcattctcgttccttttccggcagctaaaatcactgcaaaccgcttatccatttaatggcctccaatatcccttttatccatagaaaaatatatcctaaatagctgttgatttcaagaagacatcaaaaagtgcaagaattttctatgtaatcgctttattactgaaaaatcagatttaaaaaaggactgccggaaaaggccttgtgtcagcctttatcagcagtccttacattttgttatgtttaagaagccccggcttcttcatattctaatgcttcagaatcacccaaacgatgatactcatttaaaacagcatcctggatcttgccccgcgtgctggaattaataggatgagcaatatcgcggaattctccatcaggggtgcgtttactcggcatcgcaacgaaaagaccattgtttccatcaatcacacgaatatcatgtacgacaaattcgtgatccagcgtgatggatgcaatcgctctcatgcgaccatcggtattcacgcggcgtaatcttacgtcagtaacttccacagtagttcaccaccttttccctatataaaagcattagtctaacaattccacgattctttttaaattcctgcacgtttcaaaaagtttttttgaaaatataggatatacatacacaattaggtgataaaccatatttggggatcatatactgcataaaaaaagtgatcccggagaccggaaccacttttctgagatttaagattttaccagcgcaatgacttcaatttccacgagagcgtctttcggcagtctcgccacttccacacaagaccttgccggcttatgtacatcaaagtattgtccgtacacttcattcacttccgcaaactgctccatatcagcaataaataccgttgctttgacaaccgtctcgagagaagcgcccgcttctttcagcacagcttttaaattgctgaacacctgatgcgtttgttctgtgatatcaccgtttaccatttctccttcagcagtaagaggaatctggcctgagctgtaaaacatgttgtttacgatgattccctgtgaatatggcccgatcgctgccggcgcgtgtttcgtatggattgctttagtcatttttctgtctccccattctttaaatgctgttctttaaaaaatcgcagaaaattgccgttttgaatctcaatcgttttgtctttcatattgatggttgaaagcgtgagcagtgacatgtattcatcgacaagccgttcattcactccctcggcttcaaccaagacgcctatccccgcgacgtttgcattaaactcatcaagcaggctgatcatgccgttaatggtgccgccggctttcataaagtcgtcaataatcaaaacgttcgaacccgtagccaaacttcttttcgcaagcgacattgtttgaatgcggttagacgatcctgatacataattgatgctcaccgtggagccttcagtcactttattgtcctttcgtacgatgacaaccggaacgttcagataactggccgctgcgtaagcaagagggattccttttgtcgcaacggtcatcaccacatcaatctcccgctccgcaaaaacggaagcaaaaagcctgcctacatgagagaggacagatggttttcctaagatatccgttaaatatacataaccgcccggaaggatacgctcaggatttactaaagactgtcccagctcctgtataaacgcttctgcttcagcctgtttcactttcggaatgtatttgacgcctccggcagctcccggcactgtaagcagcgtcccaatgccttgctgttcaaaggtctgtttaataatcgttaaatcttcactgattgatgactttgctgattgataccgttctgagaaaaacgttaacggtattaattcatgcggatgggttaacaaataatttgttaagtccaccaatctgccgctgcgacgaaacttcatgaacttaccccaaaatccgaataatttaaaaataatataacttaacatacggatttaatcaagagcattctgttcgccgatcatccgcaccgcgtacacttgatcacagaaacctcttaacccgttataaatccgctgcacctttgattcgtattgaaccaaaccgaatacagtcggtccgcttccgctcattaacaccgcatcagcgccgaagcgtttcatttgatttttaatcatcgccacctcgggatggaggctgagcgtaaccgactccaatacgtttcctaattgtccgcataccttttggaagcttttttcttcaatcgcgtcaatcatcgcctgcacatcaggatgccgaacctgctgtaagttcagccggcggtacacttcggcagtcgataccccgatcgtcggtttggcgagcatgacccagcaatgaggcggagcactgatgtgcctgatcttctcaccgcgtccggttgccagggcagtgcctccgtatacacagaaggacacgtctgaaccgatttcagctccaagctctgcaagctcttcgacagaaagctttaaatcccaaagcctgttcagccctctgagcgtagctgccgcatcgctgcttccgccggcaagccctgccgctacagggatcacctttgtaatcataatcgaaacgccttttttaacttgaaaccgttctttaagcagtttggctgcctgataagccagattcctttgatcatccggaacaaagcgattatgcgacgccactctgataacgttttcgggcagttctgtcagttcaatccgatctgccaaatcaattgtcgtcatgatcatctccacttcgtgataaccatccgggcgtttactcgtcacatcgagggacagattgattttggccggcgctttttctaaaatacgcatagctttcacctacttctccatctaaacataagtatgaacattgtatcacatttggagacccggaggtacttatccgaaattgacgccggttttgacagccgatagaaaaaaccggggaacggattgtcccccgggccactgcattatcggttattttggttctgagccgccatctgctgttcggcaatctcgatcgcgcgctttaccatattcccggcgtcacgcgcccgaatgcctccccagccctcgtttttcaccgtatcgtaaaaaccaaggtccttcgccagctcatatttgaactcatctgacataactccacgacgtctgcccaaacgaaacaaccccttttatagaattgatcaccattcgtgcacgccacgataaaacatgtgacacctatagcttccgtttaatcggctgaaactttcgagggaataattagaagagctttagaaggcaaaacaaaaagcagtaaacaaaaggttcactgcccattaaaatgctactgagcttgccgcatcgtcattgaatgtcaattcaacagtctcagtcagaatatcagcataactgtatgaaactctttcaaacgaattctcgtcttgatctagttgtatcacaaaaacagaagggtacgtctcagctaaaatgcccgaacgctcaatcgtttttcggcggccgccgtttgcttttaacgtaagccgtttacctaaattcccatcaagcgatctttttatatcggacaacgtcttcgccattgcatccacctcactacatttattgtacaacaagagcccaattttgtcaaataaaatttaaattatatcaacgttaataagtcattgtcaacaaaattattttgacaaaattctattgatttctgcgttatttttcacaagttccggaaatttatgtatcaatatgtaaaataattaacccgcatagcgaaatatatgcgggttttatcactcatccatttgatttatacggcataccgacacgcagcacacccttcgtttcaattcctcccagccctttctctctcgtcagcgtatttctcaggacatcccatacattgatccgctccataaacggagtgaagctgattttcgcgacaatatataccgggtcaagcgcatgaatattgacgcgtgacggcgaacttgcgaaattcgcgcccgctctgattaaagactcaaaatgagattggcacgcccccgcgaatatgaccagctgatccaaatgagggactttacgcctcgctctctgaacggtttcgacaaagtgtttggaatgcctgtaggcgcttaaatcgttcacgcctcccttatgcttggaatatgcatcatggccggtgatgactaaaatatccggcctgtatttatcaagcagctcgtcaattgacgccggcatttttttctcatggcaatgaattccgtataccggcacaccgattttttcataaaagttcaggcactttttcaaataggcctcatcgccgtccagatgcaatacctttccgggcatatgaaagtagtgctcctgatgctgatattgatttgtcgcgtaatactcctgtttttcccgaagcagcttataatcctggcggagcagctcgagagattcattcatcctgctttcatctcttttctttctcatggcctgttcgtcttttctgacaggctccaaatcagaaaaatcagcatccgcaatcaatctgacttcgtcaccatgcaggatggcaattgaatttccgttgcttgtttgctctataccgataatgcgaaataaaacatccatttgataggatttcctggctaccatatctcctatttgaaattgcacgttacccactccacaaatagactaagcctcatcatgaaagaagtcttggcaaatgcacctctttccgctgcggcgcttgatgtttcaagcttttcttgcagttgaatgaataaggttctcctctagcctatgtagcggcagtccaagtggtgacgcaaaacaaaaagccctcttagaaaagggctttatgcaatccgttggacaagagcgcgaattcttctatggacagggattcaccgcgtcgctttccatcaatattcgtttcttgaagaacttcttcaatttgagcttttttctcttttccgcccggaagattgttcacaaggttgttcagcaaggttttccggcgctgtgcgaagcttgctttaatcagctggaagaaaaacggttcattatcgacgtcaaccgccgggccgtcacgaagcaagagacggatgacggcggaatcgacattaggctgaggcacaaacaccgttttcggtacggtcatgacggttttggcctccgtatagaactgaaccgcaatggaaagcgatccgtactccttagaggaaggatcagcggccatccgctcagcgacctctttttgcagcattacgacaattccttttaacggaagatgttcttccaaaagcttcatgatgatcggcgtcgtcacataatatgggagattcgccgtcaccataatttcatcacaatcctgaaactgctcttcaatgacggatttgacgtctgctttcagcacatcttgatgaatgatcgttacattgtcatacggagacagcgtatcattgagaatgggcagcagacgctgatcaatttcaaacgcgacgacctttttcgcccgtttggcaagctgctctgtcaacgcgccgattccgggcccgatttcaatgactccggtccgatccgtaatttccgcatggtccacaattctgtccaatatatttgtatcaattaagaaattctgtcccagactctttttaaaagagaaaccgtactttttcagaatttccttcgttctgataggtgtcgcgatatctttattgttcatcctgttcctcctgcctcatagcatcgagcgcatcaataaaatcacttcttttgatttgaaacatttgcagccgtttttgaagctgcttgccgtttgtatagccgatcttcagcaggtcgcccaatcgttcgcgccgtcttttggcagccggtccgccgatcagaccggcctgtatgacatcttcagctgaaatttcactcggctttgcctccatctcttcatgcacattttccagacatgctctgatgctttcaatggatgcgtgctcaacgccaatgccgcgcttgtttttcggtttggcaagatgtttgggcagaaatgcgtgtttacagccgggtactgcttcagaaatggttttccggatcttctcccccggaaaatccgggtccgtcagcacgatgacccctctcgtttcctgcgccagccgaatctgcctgatgacttcgtctccgattgcggaaccgtttgtctcgatcgtatccgcatcaacggcaagttttatgcgcgcagtgtcatcgcgtccctcgactactataatttctttaattttcattacttcctccaaaaaaactttttatatccaaaacgaaacctttgcttgcatgtcacgtctaatatactgaaaatacactttacctattataacgaaaaaaacagagggcgcaaaaccctctgaatgaatcggaattaatttaagatttttattttgacctgtttctttccccagcggtaagctgaagatttttcagggaaaaagacatcaatccgtcttcctttaatggctgagcctgtatcagcggctacggcatccccgtatccgtctacgtggactcttgtgccgagcgggatgacgcttgggtctaccgcaatgactttggcattcggattgcttgtcaggttaacgcctgtagccgtttggccggaacagccgctgcagcttgcggtataagccgtggaagacacggtaatcactttaccggaagatccggtttcgcccgaagatgccttcacaggtgcactgagctgctcaatcttgggactgtgccgctttgtgccgaccgcaatgatctgatctttgcttttttcagatgtttcttctttgacaagctttcttgatacttcttttccattttctttgacaacatgaaaatgctttttaagtttgccttcttttcctttttgaacgatcttttctttcccgctgtcgagagacgcatcttctttttctttcacttgatacgctattttttcctcaactacatcggtgactttttcgatacgagtgatttgtatgccggcctgattttttgtgagcttttcgtgtaatgccggttttactttatcttcgtctttcatgtccatcttatgctgcgttaaaaagtcagcgaccgtagtcgaagtcgtccatattttctttttctttcccgcatcatttacagtgacctgaaaagccgggtcgaccgtgactttcatgccgtttgtcactttcgtatctgctgctggatctattttatcgtgctgattcacaggtgtatgctgttcgttcagaaatgcgccgactgtttttgccgttgaccataaagtcttttcttctccgcctcttgtcacacggatctgctttgcagcatcatacacgacattcatgttgtctgccaatgctgtctgcttagacggggtaatccggtcttcatttctcgtctctatatgtaaatcttccagaagttccccaaccgtttttgcatgagtgcgtatttgctttttcttgccgttgatggaaacagaaactgattgttttgagagctcatgtgccccgtatgcagtcccggttccgcccagcagaataatagctgcaatcagaataaccttgcttttaccaagctttacggaaaacagttttttcattttttgtgtgatgaaaaacgcctccttctcctcggagagattatatagagtatctaaaatgctgtcaaccctcccatctcgaagatgaaaaaccttcagcgtatccctcattatgcaaaaacaaagcaaaaaaaggaagagagacatatcgacaacctatcttatgaggagaaggaagcttgtagaaccgttttacatatccactgaatcggacaagcttttacacgttatgacagcgcattctgtcagttcatgcggaaaagtctttttgcgttttcggttgtaattgaggcaatttcttcatatgtcagcccttttaattcagcgagctgttcagcaacatattttacgtagcttggctcatttcgtttgccgcggaaaggatgcggtgtcaggaaaggacagtccgtttcaatcagcaaacggtcattcggaatttcctttgctacttcttttggtttcttcgcatttttgaaggtaaccggtccgccgaatgaaatatagaaattcatatccatacactgccgtgcaacctccgtgctccccgtaaagcagtgcataatgccgccgacttcttccgctccctcttctttcaaaattgtgacaacatcttccgttgcatcacgattatgaatgataattggaaggttcacttctttggcgagagcgatttgtttccggaatacttctttctgaatgtcttttggtgatttatcccagtggtaatcaaggcccatctctccgatcgccacgactttttcgtgagaggacagttccttaatccatgataaatcttcctctgtcatgtcaattgcgtctaccggatgccagccgatcgcagcgtatataaagtcatattcctcaatcagctccatcgcacgcgtgatagtgggtttgtcgaatccgacaacgacaattcgttcaactttttcagcctttgcacgcgcaatgacttcctctaagtctgtgtcaaattgctcggcatttaagtgcgcatgtgtatcaaaaagcatcataaaaactcctttcttgttgaaaaacaaaaggtgttcgacggaatgttacacgtgaaacaccttttgcccctattatttaattcgagtgcctttcggtaatgactggtcgacagctacaactttgagaacgccgtccgattctcccgccagtatcattccttgagaaagctcgcctctcagttttaccggttttaaattcgttacacagatgatcttcattcccacaagctgatccggtgtgtaatgcttcgcgatacctgatacaacttggcgctgttcaaagcccagatcaatttgcaatttcagcagccgatctgcttttttcaccggttccgcggacaagacttctgcgacgcgaagttctgtatccataaattgatcaaacgtaatttcaggaagacgctctgcttcttgcggctcttccgccttttcttctttagcaggagcagttccttgcattttttgcttgatgtaagctacttcttcttcagcttcaagacgagggaaaagcggttccccttttttcactttcacattcttcaattggccgaatgtctgaatgctgtcccaagctttaagagactgatcctcaactccgagctgggaaaacattttttcaggcgtctgcgtcaagaaaggctgtagcaatacggccgaaatacgcaatgattcagctaaatgatacatgacagaacgtaattctttttctttttcctgatctttagcaagcacccacggagcagtttcatcaatatatttgttcgtacggctgattaattgccatagcgttgataaagctactgaaaactccatgttttccattgccttttcataagctttaaccgtttcaccggctacggaagaaagctctgaatcaaaatcggtcacatttccttcatatgaaccaatctcgccgtcaaaatatttttggatcattgcgactgtacgattcagaaggtttcctaagtcgttcgccaagtcataattaatccgttctacgaaaccttccggcgtaaagacaccgtctgaaccgaacggtacttcgcgaagcaggtaatagcgaagttcatccaagccgtagcgttcaattaacgttaccggatcaacgacatttccttttgatttcgacatttttccgtctttcatcaataaccagccatgcgcgaatacttgcttaggcagcgggagatcaagcgccatcagcataatcggccagtaaatggtatgaaaacggacaatttctttaccgacaaggtggacgtcagccggccagtactttttgtaaagctcatcattttccgtatcgtaaccgagcgctgtaatatagttgaacagtgcgtcaatccatacatacacgacatgcttcggatttcccggcacttttacgccccagtcgaacgtcgttctggaaacggccaaatcttcaagccccggtttaatgaagttgttaatcatttcatttttgcgtgattcaggctggatgaaagaaggattttcctcataaaacttcagcaggcggtctgcatatttgctcatgcggaagaagtatgactcctctttgattaattcgaccgggtggccgctgtcagggctttttccgccgacaacctcacccttctcatttcgttccacatccaccagctgtgtttccgtatagaatgtttcatcagggatgctgtaccagccctcatactcatccaggtaaatgtcaccattatcaagaagtttttgaaacactttctcgataatttctttgtgccggctttccgtcgtccggatgaaatcatcgtgagaaatgtcgagctgcttccatagcttttggatttcagcaactgcgcgatccacataagcttgaggcgtgatattctcttcctccgctttctgctggattttctgtccgtgctcatccgttccggttaagtagcgtacgtcaaatccttttaatcttttgtaacgcgccatcgcatcgcctgccacggtagtataagcatggccgatatgtaattttccgctcggataatatatcggggtcgtaatataaaaagtattattgtcttgcggcatgttgcaacctcccattcagaatgtcgaaaagctcacgcccaaaggacgagagcggttttatttgatatacaatattgatatttgtcctctatctatgataccatcttagcctttaagatcaaggatatatacgtactgcgcgtaaaagagtaaataaaattaaaaatttttattgaaattaaaaaaagtcttaacatgtcgaaatttgtcgtatataatctactaatataaaacatcttggttcgaaagtcttgatttaaaaggattttcagtaggataataggttcgaaaaagcagtcaaaaagcctgttatttcaggatttccaaggctttacttactataagaactaattcttacaaacaatagcaaacaaaaagattgacgattattggaaaccttgttatgctaggaatgtaaggaattttgtcgaataatgacgaagaaaaatataaactacaaataattatctctcgggaggagactgttaatgaaatctactggtatcgtacgtaaagttgatgaacttggacgcgtcgttatccctatcgaacttcgccgtacactgggcatcgcagaaaaagacgctcttgaaatttatgttgatgatgaaaaaatcatccttaaaaaatataaaccaaacatgacttgccaagtaactggtgaagtttctgatgataaccttaaacttgccggcggcaaattggtactcagcaaagaaggcgctgagcaaatcatctctgaaattcaaaaccagcttcaaaaccaaaaataagctatttcatacaaaaaccgttcttgttatgacacaagaacggttttttttatgattgaatgtgataagcgtcataaatctcgcgtttcggtacgtcccgatctaccgctgtttgttttatggcctgtttggaagaagatccttcatttatgtaatgctccacatgttctttctcagaaagctccgcccaccaaggcttttcctcttcatccggttcagcgccttgattgccttcgacaacgagacaaaactcaccgcggatttgatcttcatttgcccattcaagcacctcggcgatggttcctctgatgaattcctcatactttttcgttaattccctcgtgacggcgatggttcgattacccaaaacgtcatgcattgctgttaatgtttcttttaatctgtgcggcgcttcgtaaaatatcatcgtttcctgccgttttttcaggatttcgagttctttcttcttttcttttttttgtctgtttaagaatccgtagaagaaaaacggctgcggggtgatccctgatgcagtcagcgcggttaatgccgcatttgcacccggaagcggaacgacatatccgccgatttgggtgaaatctctcacaatctcagcccccgggtcggaaattgtcggcataccggcatcactgaccaatgccacattctttccgcttttcagccattcaatgattttatggccgctgctttctttattatgttcatgatagctgatgagagatgtttctatgtcataaacatggcacagctttttcgtctgtctcgtatcttcggcagctatgacatcggccgatttcagcgtctctactgcacgaaaggtcatgtcctccaaattgccgatcggtgtaggaacaaggtacagagttcccatttcagattttccgttaaaactcatctgacgtcttaacatatacagcctccttgctgcgtcgtttttcttctatatattgctcttttttctttcgggtcagctgcttaaaacggtattccgcctgcatcgcttcccgttttgtttcaaatgattccgcatggcataacgaaaccggccttctcgcccttgtatatttcgcgccctttccctcattgtgggttttcagccgtttttgcagatcatttgtataaccggcatacagactgttgtcattgcacagcagcacataaaagaaatgactatttgtctccatataaaatcgtgcggatctctttcgtatattcattttgttcattatatacaaagagcgggggaagaattttgagatcagggcggccgcctttaattccttcaaccaaaatggtattcgcttctttaccttgtttcggataaataaactgaacccgtttcggttctattcggtatgctttcattagttcaaagatttccagaagcctccccggccgatgaacgagagccgcttttcctccttgcttcagcagtttgctgctgacggaaatcacatcttcaagcgtgcaaaggatttcgtgccttgcgattctgagatgctcgttcaggttctgctccgcctctttcggtgttttaaaataaggcggattgcaggtgacaacatcatatttattatgtccgagtctttccggcatatttttcagatcatcatgaatgagactgatctgaccgcccagcccgttgtattccacgcttcgaagcgccatatcatacaagcgttcctgaatttcaactccggtgatatcggcttttgaccttgtgctgagcaaaagcggcacaatgccgttccccgtgcataaatcaacaatgttccccttttgaatcggaacgtatgcaaacttagacagcagcacggcatctaatgaaaaagcgaaaaccgtcggactctgtactattttcatatcctctgctaataagtaatccaatctttcatcatcacgtaatgaaaccataatcttattcctttcggcactctttgaaaaaggcttccgacatcagcggaagccttttccttattttttatttaagaaggacagacaaaaaaggcaatctcccttgcggacgctcccataatggacgttgcaaatatgaaagccttcttgatacagccgggccagattgtcgtacccttctcctatatcactctgctctgccttctgtgtttttgtttctttctgatcggctttgaacttctcaatttgctccgtcgtgtcatcaagccgcttacgcaaatgcttattttcaagctgaagatggtgattctcttcaatcatttcgccgatatgctgctttaagtcacccagctgacggtacagcgaaccgatttgttcctccaggtttatgacagtatcaaataactcttttttatccaaggttccacacctcgttaatctgtggtttgtgcggatacgacgccctcttccaagagctcttcccaagtatattctatcactttttcacgattcttcagttccacctgaagcacccgttccagaatattaagaccgacaacctttgcggggccgtttgccgtcgtaatcatttcgcctaaatccggcagctgttcttttgccgtctcatactcatcattttcatacttcaaacagcacatcaaacggccgcacagaccggaaatcttcgttgggttcaacgataaattttgatccttcgccattttgatggacaccggttcaaaatcaccgaggaacgtggagcagcaaagcattctcccgcatggtccgataccgccgagcattttcgcctcgtcccttaccccgatttgacgcaattcgattctcgttttaaagatagaagccaagtctttgaccaattccctgaaatcaacccgtccgtctgccgtaaagtaaaaaatgactttattgcggtcaaacgtaaattcaacatcaaccagcttcatatctaagccgtggtcagccacttttttctgacagacttcaaaagcggacagggcctcctgtttgttttcttctacaatgagaagatcgcgttcatcagcaacgcgaataacctttcgaagcggaagcacaacatcatgctcgtccacttgtttatttgcgatgacaacctgcccgtattctacacctcttacggtttcaacaatgacgcagctgtcttgttctatatcaaatccattcggatcaaaataataaattttccccgcttttttaaagcggacgcctattacgttgtacaagcttatccctcctgcaacgttaacaccaagtgctccattaatccctgcacattcacattggaatgaagccgtttttttgcttctaaaacagcgagaatttggttcgtaacgctttgttgtgtaaattgcagcgcatgctgttttattgattggaataagtcttgataaatcagtttatcttcatttccaatttggatggataatacatcacggtatatcaataagagcatatcaagacccatttcttgatgggttttttctttgaaaaagggcacccactgatcctgaatgaagaaaaaggcatgtcctttccgctgatgtaagacttcatacaattttatcactttcgctctggactctgcaaactcatcatttcgacttaattcgactgcttccgcaatattatttgtcatatttgctaagagccgggccatgtgagggctcacttcctgttcaatcagtctttcttctatggctttcggctgaagcggctggaacgggagaacctgacatctcgaaacgatggtatccagtattcggtggagctgctcagtaatcagaattgcgatggtgtcttgactcggctcctctaaaaacttcagcagactgtttgccgcatttgtggtcatttgatccgcatgggatataatgtacagctttttatgcgattccagccccgttttggaaaactcttcctgaagcgattggatctgagcctttttaatggataatccgtcgggctgaaccacatgcaggtcgggatggtttccggattcgatacgcttacagttccggcactctccgcaaggctcagtcccgtcttcaaggcaaaaaaagctttttgcgagaagcagtgcggcatccaatttgcccgtaccttttttgccttcaaacagatatgcgtgagaaagccttttcttttcaatgctgttatgcaaaagccgcatcactctgggctgctgcccggtcatttccttccatgatattgccattgtatcactctctatgtgtaaaggttaatcaataaaccttttatttctccgattcgatccagcaaatcaattgccggtttttcctgatctaacatttcttccgtcagctgaagcagtttttcatctatttctttcacaagccccagggtccggctgctgccgtacaagtcaaagcttttctccgtctcatgcgataatccgctgtctacggcctcttttacaaaacgttttaccaatcctttgaacttcgctaagtctttgaagtttctcgacttcgtcagccttttcccgaacgtttctatatccgttaagaacctgctcagctgatcaaatttcagcttgctgctttggctgtccattgaacttttaaacgttccggaaagctctgccgctttataagcaggctgctgctttttctcaataaatgtacgtaagtcagaatttattttcacgtcgtcaaatccttaaaattgatgaaattcatcgaccgggaggacaaagaccgtcgctccgccgacttccacttcgacgggatatggaacgtaggaatccgcattcccgcccatcggggataccggggcaatcatctgatcacgtttacagccattctctttaatgaggctgagcgctttatcgacacggatatcttccaccccgatcataaacgtcgtattgcctgatttaaggaatccgcctgttgtcgcaagcttcgtcaccctgaagttgtggtcggttaatactttcaaaagcctgttgctgtcctgatcctgcaccactgccactattaatttcattctctaggccccctttaggttggaaagaacattgtcgttacattcattatagcaacttatgagaaacaggtcacaactgaatttttttcaatgcttcatttatcacttgaagtgcgtcctgaatgacgagttccttctttttcgatgcgtcgattgtatggaatctttccggaaaacgctgcataaccttttggtatccttcccgtactttcgtgtgaaagtgcagagcctcaagatcgagacgattcttttctcttgaatcattcgacgtaatccgtttcaacccttcttcaggctcaatagaaaaatagatggtgacatcaggcatcgtatcgccgattgcaaactggttaatagaaagaacttcatcaatgccgagccctctcgcatagccttgataagccagcgaactgtcgatgaaacgatcacacagcacaatgcgcccttctttcaatgcaggctgcaccttttcggttaaatgctgtcttctcgccgcggcgtaaagcagcgcctccgtttttgcatccatcagtgtattgtttttatttaagatcacttctctgatctgttccgcaatgtcgatgccgcccggttctcttgtcgctgtcaccgggagcccctctgccgacagaatctctttcagttcctgaagcacagtcgttttccctgcaccttcaggaccttcaaatgttataaataaaccgctcatgatttctcctcttctatatagacaagtaattgttccccgtttaacaagccttgaatatgcgcgtccatgccgattaaacgggaaagcttctgtacgatctcttctgttatccgttcgccgtccatgatcagcggaattcccggcggataaggaataatgttccccgcatgcaagcgcccggccgccttatttatatctgcaggctcttttgtaaacttccgcatctcattttgcggatattcaagtgtcgaaatggacggaaatgtccaattcacggcatccggcaatttatcgggcggtgtattctccagtttctgctgtatgtttcttacggctgcctgttctatcatccgccggccgcctatcgacagtacgagcaatacttggtactcgtcagccagctcggcaacaatgccctcactctccaaaatgcgttgtaatgaatagccggaatgtccgagctttgaccgaagtattaattttaacgggtccgcccgcagcccatatccggaaggctcgattatttcaatagaagaaattgatgcgaaccttcgtttgattttctcaatgtgctccatatggacgggaagtgtccctttttcagcaatatcctgcacataagcacgcgccgtatctaaagatgccataatcgggtatgacgggctgctgctttgcaaactgcttacataataagttaatcgatctctgtcaattcgggtgctgtttaaatgaaagtaagatcccatcgtcatagccggaagcgttttgtgagccgattgaacaacggcgtccgcccccatagccaatgatgaaggcgggaaaggctgccctaacacaaagtgagctccatgagcctcatccaccagcacaggaacaccgtatgaatgggcttttttaactgccgcagtcaaatcggcggcgtgtccgtaataagtcggattggtcaaaacaagtcctttcgcgttcggatatgacgccagcgctttttcgatgactgaaagagatacatgtgccggcacatgcatattttcatcgatttccggcgccaaataaaccggcttggctccggccaatgccaccgcatggaaaacagacttgtgacaattacgctggatcagaatgggttcacccggttcacaaacagctaaaatcatcgccagattgccggcggtcgttccgttgacgagaaagaagctttcctgagagccgtacaatctgctcaccaaatcctgcgcttccttaatgacccctgtcgggtgatgcaagtcatcaagacccgtgatctcagtcatatcaatagataaaagagattgatatacagatttcgcttcatcaaaaaagacatctccattgtgatgtcccggaacatgaaaagaatacgtatttcggtgcgcatgcttcatcagcgctgtatataaaggtgtgtccatttttaaacaaatcctttgcctgtctttcttattatatcgtgcctgcgagccaacttaaagctaagactttttgccatctagccgttatcccggccggaactcatatcaagcagcttcttttttaaatcgccttccatgataacaagctcctcctcggcacgcctgcgtttcatcctgccttcttcttgaatagacatgatttcttcaagtgtgctgactaagctttcctgcacttttttgagggtgtctgcctcaacaagtccgcgctcattggctttggccgtctcgactgtgcttgttttcagaagttcggcgtttttcagcagcaattgatttgtcgtatccgccgccttcttctgcacatctgccgcactccgctgcctcataagcgtcagcgcgatggcgacttgattcttccataaaggaatagccgtaacaatggaggactgaattttctctgccagtgcctgattcgtgttttgaatcagacggatttgcggcgcactctgaagcgtaatctgcctgctcagcagcagatcatgcaccctcttatccagacggtcggcaaactggcgaagatcattcacttcctgtgcggccatttgattgtgttttcgtaattcggcttttcttgccacttcgggaataagctttgttttcagctcatctaattttaattcacccgctgctatatacatagttaaatcagaaaagtattgtttattttggacgtacagctgatctaaccatttattgtcactcaacagcacatttttagaatgttccagccttctgctgatacggtcaatctgcacacttgtcttttgatatttcgaaagcacttcctgcacagatccggatacccttttaaacagccgggcgaaaaaccctttgttctttacctgcagatcatcggggtttacctggtcaagcttcagcatcagatcagccaatatctgtcccatctctcctgcatcttttctttgcacgtgctctatcatcgtgtgggaaaattccagaagattcgcctgcgcctgtgaaccaaacagaacaatgctttgcatgtttccagggtccagtttttcagcgagctgaagtgccgcttctcttttttcttccggcagcgtatctgcaagctttagatgagtctggtcattttgggcgcccatactgtcgtcggaacggtctttggccatttccttcttcctttcttattttctcagtgaatgctttgccatatctaattcaaagtgcaggtcgtcgatgtcctccttcatcagttcatgaagatcttcttccagccttctggaaagctccgccagagtcatcctcgtctcactcaaggacattgataaatctttattttttcgcggctgtgatgagagcaaagcatacttttccgtcagttccacaacagaatcaagcgtttgataatagaaacgctctgcctgataaaaacgcttcggctcctgctttgtgagcagatatattcgtcgggttatccgcagtatctctgcattctgcttcagcatttgtatacttttagagcggaaaagcgccctgcgtaatcggatgattttaccctttgcttcctcgagattttccttgatataagcatattcttttcttgtcagccggtgtttttttaaaaagagacgcttcgcattccacaagccggacgcactgactgcggctccgccggccgccccgtataaaagcgaatacagaaaaggctggtgccctatcgtaaagaaggttatccccgctaatacaaaaactgtgctgccgcaaaatgtccatttcatatattgaataaacggtttcatacttgatcgactcctatttattcacttttatcagtattatctattacattccatgtctaaacaagttcctcttcttatcgtatcagttcttttataaaaagtgaaaaaactcctctgatttcaggcaaaaaaaagacccttttcagggttaagaatataacgtcggtgtatgaaggcttttcaatttacgaacgaaaaattcataattcggatcagaggtcggagtggaaactactttcttctcacactctaaacatataaatttcgtataaatatggattcccctgcttttcttggtttcacacacaatacatgtttcttcatggccggacgtttcattcattttgcccacctccgtatgaatagccttcccttaaactgttgattgtatacacaatttggatctttttgaagtttgcaattagtatatgggcgttcccgtatttcggtgtttgtttcgtttttattcaaaaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtcccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtagggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaaattccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagccttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtgtttgactgactacgcacatcgctgtgcgatttatttaaaactttgaattaacaggtacgttttgtcttgtttagttttcaaagaactttgtccatcgctcttgaagcgacttaattattataacatctcagtgtcattgtcgtcaataactttttaaaatttctttttcaagaattcgtttcgtcatcagcgacgtatattagaataccacccttgatccaacatgtcaacaataatcgacaaattaaatgatgaagcgtttaatgactatcaaagccgcgataccgggaatcccaagaattccgctgatgcccgttgtaatcaggttaacagggatatgaatacccagactgccccgaacaagttcacacccaccaacagaatcgcgccggcaataaacttaatggcagtcacaccaatccaccttaacggttttgaagatactccccataaaaaaagcaaagcaaccagaccgacaatcaaaccgataatgaaaaaaggctccatgaatcttccccctcgcttgtttagtacaagcttatgagaagattccggagaatagacctcttacttccatctgctcattttcaaattccgctgcttcgcttctttcaaataaaaaaagtacttagattcagcgactttcagctcaaacaacacctcagcggagggctctagacttttctcgaccagactcttctgtctgttccattcttctttttgtttaaagagctgttctatcagcttctcgtcaaactcttttcttaatgtatttctgcgaagaaaacccatgccttgccttttcctcccttacaattcacgtcttccttcaagagcttttgaaagagtgacctcatcagcatattccaaatcaccgccgacgggcagaccgtgggcaatacgggagagcttgatgcctgagggctttaacagccttgatatatacatcgctgttgcttccccttcaatattagggttggttgcgagaataacttctgtcacttgatcatcctgaagacgtttcagcagctccggaatcttaatatcctccggaccgatgccgtccattggtgaaatcgcgccgtgaagaacatgatactggccgttatattccttcattttctccatcgcgatcacatccttagggtcctgcacgacacaaataacagacttatctcttcttgtgtcctcacatatataacaagggtcctgatctgtaatatgtccgcaaatcgagcaatatgtcagattccgcttcgcattgacaagcgccttagcaaaatccaatactgtgtcttctttcatacctagaacaaaaaaagccagacgaaccgctgttttcggtccgatccctggcaatttcataaagctgtcaatcagctttgatattggttcaggatactgcatgtttatttatccccctagaataaacccggtatgttcattccttttgtaaattgtcccattgtctcattcgtcatgtcatccacttttttgagggcgtcgtttgtcgcagcaagaaccaggtcctgaagcatttcgatatcttccggatcaacaacttcttctttaatggcaacgtctacaacttctttttggccgttgacttttacagtcaccataccgccgcccgcagtgccttcaagcactttttcagcaagttcctcctgagccttcgccatatccttttgcattttttgcatttgtttcatcattttttgcatgtttcccattccgccacgcatattcaatcactctctttcatcttattagtcttttatttcgattaaatccgctccgacaagttttttcgcctctgcaatcagcggatcttcttcagccggttcgtttgatccttcactttcctgctggtgatcatttaaaaattcttctcttattttaccccattgtgcttccggaacgccaatcaaatccattcttttcccgagcattgattcgagaatctgttcaagattcgtacggactccgttattgtcttctgcaaccattttacaatggatttcgtatttaaatttaagcacaaatgccttttgagcagcggccaccggttcactgtcattcaaaagagccgcatgagacaccttattctgctgtttcaggtgtgccagcagcttgccccagctgcttttaagctgttcaagatcaggtcttgtggcttccttcaatatctcatgaattcttccgaccggggctttataatggctttttccgcctttttgaggacgcggagcttctttcggagcgctttccatctgaaccttcacaccggaggttttcagcctttctacttcctgctcaagctgctggatcttattcatcagcatgccgacctcagggatgtctccggcggattgctgtgccgtttggcatattttcacgacagccacttcaaaaaagattcttgggtggttcgtccacttcatttcctgatggcttttattcaggatatcaatcatctcatataaagcggggccggtatgtcaccgctcagattccgaaacgtttcatcgaccttcaccttctccaggactccttctaaaccgggagcggcctggtacaagagcatatccctgaaatagaaaatcatatcttcaatcagtttggccgcatctttcccctgctggagcaattcattcagtgtttccaatgcctcggaaacctgtttgcggtgaagagcagatgccagttttccaatatagtgctgagaaacggctccggtaatgagcaaagcgtcatccaccgacagctcctcgccgctgaatgatacagcttgatcgagcaggctcagcgcgtccctcattcctccgtccgcagcactcgctatgatatcaagggctccttcttccaccttcagctgctctgcatcgacgattgtcttcattcgtccgacaattgctttggatgtaatccgtttgaagtcaaaacgctgacatctggagataatggttaaaggaatcttatgaggctcagtcgtagctaatatgaaaatgcaatgtgccggcggttcttccagcgttttcagaagcgcattgaatgcgccgatagagagcatatgcacctcatctataatatataccttgtaagtaacggccgacggggcaaattttactttgtcacggatgtcgcggatttcgtctacgccgttattcgacgccgcatctatttcaatcacatctgatatagagccatttgtgatccccttgcatgccgcgcactcattgcacggttcttctacaggggcgtgctcacagttgactgctttcgcaaatattttagctgcactggtttttcccgttccccgcggtccagaaaacagatatgcatgagaaaatttcttttgcaaaagggcattttgcagcgttttcgtaatgtgttcctgtccgaccacatcttcaaactgctgaggcctaaatactcgatataaagcttggtaacccacaggatgcgccctcctctgttattcatcatgtttattatacatgaacgtgcttttaacgccaaaacccgtttttcatatacgaaaaaactcacctgccataacaggtgagtctgaaatttgatgattgatttaccgtgcaccttctgtcgattcgctaccctaagcgttacttaagcagttagctcagcccaggcaaccctgcggcacatgagaggtttcacttaatgctgcttccttccggacctgacatggttcatgaattcccattgcgcaggacccagacgtcaacgccacttacttaaggcagaccttacagtaaacgaacctcgagaagggattcggccccgctagagcggattgcgggtacagggcaccgctacctccccgcttagcacggcaaaataaatatcaaattttgatatgcgcaccattcatgatgcacacataagtatatctgcttcaggcagaaaatgcaaccgtactactcagacaactttttcctcatgtctttcttttgccggcgcagctttctgaaaaaagcgctgagcatttctccgcactcttctccgagcacgccgctcaccacttccgcttggtggttgaaccgctcttcctgcaagaggttcatcagcgttcctgtacagcccccttgggatcaaatgcgccgaatacgaccttatcgactctcgaaagcacgacggctcccgcgcacatcggacacggctccaaagtgacatagagaacggcatcctcaagtctccatgtccccagcttacggcacgcttcgtctatcgccagcatttcggcgtgggcaagcgacctctgttcagtctcccgcagattatgcgcccgcgccacgatctcatcgtgcagaacaagaactgctccgatcggcacttcacctttctcttcggctttcttcgcttcttttatggcttctctcatataatattcatcattcatcggttcgagctctcttcttaagttttttcatgtctcataaaggttaaaataggaataccccagcagaaaggagttgccggtattgtctgaacctaacaacacagcccttctgattgtcgatatgatcaacaattttcaatttgatatgggcgaacgtcttgctgaaaaaaccaaacaaattgtcccccgtattttatcattaaagaagcatgcaaaacaaagcaactggccgattatttatattaatgatcattacgggctctggaaggctgatattgatgccatcagggaggaatgcagcaacgacagaagcgcctccattataaaagatatttcgcctcagccggatgattattttctcattaaaccgaagcattccgctttttacgaaacggcgcttcacacccttctgaccgaattacaagtgaaccgattaatcatcacggggattgccgggaacatttgtgtgctgttcacggccaacgacgcttatatgagagaatacagcattgccattccgaaagactgcaccgcttccaataacgacgaagacaatgatttcgctttgaccatgatggagaatgttctcttcgcagaaataaccacggaaaaacaaattaccggcgaaaaataaacatgatcagcctccttttttcatatatttgatagcggatatgaaaggaggcgtttttcattcagatctatatagtgaaacggggcgacacgctttccgctattgcggcgcgctaccggacagccgcaaatgtcattgcggaagcaaataaactgcctaatcccaatacattggttgtcggacaaacccttgtcatcccgattgagggtcaatattacgaagtaaaacaaggtgatactctcgcgtcaatcgccggccgttttcatatatcggccgcggagcttgcgagggtgaacggaattcagcccggcaccacattgagagtcggaacccgcctttacattccgcagcaggcgaataagcccgatatcgaatcaaacgcatatatagaaccgcggggaacgagcgtaagcgctaatcttcagcaggcggcaagggaggcctctccttatttaacatacctcggcgcattcagttttcaagtgcagcggaacgggactttaaaggaaccgcctctgaccaatttaaaaagcatcagtgacaggcacaacaccacactgatgatgatcatcaccaaccttgaaaatgacgcattcagcgatgaactcgggcggctcatcttgaacgacaatacagtgaaaacaaaactctttcaggaaatcgtctccacggctaaaaagtacggctttcgcgatattcactttgatttcgaatatttacgtccacaggacagggaagcctacaatcgttttttacgtgaagcgagaacgatttttcatcgggaaggctggaagatttcaacggcgcttgctccgaaaacgagcgcgactcaggccggcaaatggtacgaagctcatgactatagggcacatggagaaatcgtcgatttcgtcgtgattatgacatatgagtgggggtacagcggaggcccggctgaggccgtatcacctatcggccctgtaagaaatgtcattgagtacgcgctgacggaaatgccttcttcaaaaatcgtcatgggccagaatatgtacggctatgattggacactgcctttcaaacagggaacgacagcgaaagccgtcagtcctcagcaggcaatcgctctggcagcacgctataaagtcgacattcaatatgacgaaaccgcccaggctcccttcttccgatacacggatgcaaatcagagacggcatgaagtatggtttgaagacgcacgatccattcaagcgaaattcaatttaattaaagaacttcatttaagaggaatcagctattggaaactcggcctttctttcccgcaaaactggcttttgctcggcgatcaatttcatattgtaaaagagacgtttcgttaattgggagcgtcttttttcatgggcttttctgtgagtgtgatacaatataaaggccggcagctgacggatgtttgcagaattaaggaggattttcaatgaacagagccccttttatcgcggtagaaggtcctatcggggcaggaaaaacgacactcgctacgatgctttctgaagagctcggttttcctatgattaatgagattgtggaagacaacccttatctcgataagttttatgacaatatcgaggagtggagtttccagcttgaaatgttttttctatgtcacaggtataaacagcttgaagacaccgatcgagattatttaaaacaaggacagcccgttttgtccgattatcatatttataaaaatgttattttcgcagagcgtacattgcacggccaaaagcttgagaagtataagcagatctatcatctgctcactcacgacctgccgaagccgaatatcattgtatacataaaggcaagcctgccgacattgcttcaacgcattgaaaaacgcgggcgcccgtttgagaaaaatatcgaacatcaatatctggaacatctcattgcagattacgacacagccatcagacagcttcaggaagaagatccggatatatctgtactgaccattgacggtgatactgaagactttgttttgaataagacagactatgaaagaattgcccgtcaggtaaaggagcttattaaatgaaagacattcatattccaaacaacgccattataacagtagcgggaacggtaggagtcggaaaatcgactttgaccaaagctttagcaaaacggctcgggtttcatacctcacttgaggaagtggatgaaaacccttatttagagaagttttatcacgattttgaacgctggagcttccatttgcaaatttattttctggctgagcggttcaaagagcaaaaaaacatgtttgaatcaggcggcggattcgtgcaggaccgttcgatttatgaagatacaggcatattcgcaaaaatgcatgccgataaaggaaccatgtcgctgacagattacacaacatacacaagcctatttgaggcgatggtcatgacgccgtatttcccgcatcctgatgttttgatctacttagaaggcgaccttgaatacattataagccggattgaaaagcggggccgcgagatggagctgcagacaaaccgctcttattgggaagagatgtatacacggtacgaagactggatcagcggttttaacgcctgccctgtactgaaagtacgcattgaagattatgaccttgaagctgatgaacagtcactggaacctttgatcgaaaaaatcagtcacgtgatcagcgaaaacagaaacaaataaaaatagcaaagcgattttccccgaacagagaaaatcgctttttttgcatataaaaaatccgctgcatcagatgcagcggacaaaacaatctccaatatatgctcgagtttcattaggtttaaaatcaatatggcggaggaagagggattcgaacccccgcgggctttgacacccctgtcggttttcaagaccgatcccttcagccagacttgggtattcctccgtatcgacatttaataatataccacatgacccaaatttcagtcaagcgctttttcatattttttatttcatttcttaaacagcttttccgtcagctttactatcatacaaaagtcttgcgtccaattcaacctcagtatgccatacgggcaggaaaacaaagtaaaaatcaagaatagattcaaacagataacctgctcataaaggtggagaacataatgaaaatcatcatcgcacccgattctttcaaagaaagcatgacatcaaaagaagccgctgacagcatagaaaaaggattcaaagcggtcttccctgacgcggaatataccaagatacccgcggccgacggcggagaaggaaccgttcaggctttgacggatgccactggcggaagcatcatcaaaaaaactgtgaccggtccgctgggaacgccggtaaacgccgcatatggacttctgggagacggacgcacggcagtcattgaaatggcggaagcatcgggactccatctcgttccccgccatctcagagatccgttgaacacaacgacaagaggaacgggtgaactgatagcggatgcagcctcccgcggggcgagtgagatcatcatcgggcttggcgggagtgcaaccaatgacggcggaacaggaatggcgagcgcgctcggtgtgcgtttcttaaatgaggaaggtcaggagatacatgacggaggaggcgctctgcacaccctagcttctattgatataagcgggctctcccctgatctgaaacatatccgttttcgtgccgcatgtgatgtcgaaaatcccctgaccggtgaaaacggcgcgtcatatgtcttcggcccgcaaaaaggggcgtccgagaagactaaagttgtattggatcgcaatttataccatttcgctgacgtattgagacgtcagcacgatatcgaagcggataccgtaaaaggcgcgggcgccgcaggggggctgggcgctggactgatcgctttcttacaggcagaaattcaaagcgggattgacgttgtattagatacactgtccttctcagatcagataagagatgctgaccttgtcattaccggagagggccagattgacggacaaacgatattcggcaaaacccccgccgggatcgccgcacgcgcagccgctcaagaaattcccgttatcgcattggcgggctccttaggcaaaaattttgagcatgtttacagcgcaggaataacagctgtattttctatcgtgcccggcgctgtaagtcttgaagacgccttagcatccggccgttttaacctggaaagtacagcccggaatgccgccgctctataccgggcagcaaaaaaggcgcgcctctagggcgcacctttttatggtttgatgacttctttatttcccatataaggacgaagcactttaggaatgatgacacttccgtcttcctgctggtagttttccaagatggcagctacagttctgccgactgcaagacctgaaccgtttaatgtatgcacatgctcaggcttgcctttcgcttcgcgtctgaaacgaatgttcgcacgtcttgcctggaaggcctcaaagttgctgcaagaagaaatttcacggtatgtgtcttggcttggaatccatacctcaatatcgtactttttcgcagctgtaaagccgagatcaccggtacacatgctcatgacgcgatacggcagttcaagcagctgaagcacccgctcagcttgatttgtcagtttttcaagctcctcataagaatcttccggcttcacgaactttacaagctcaaccttgttgaactgatgctgacggatcaaaccgcgtgtatcacggccggcggatcccgcttctgaacggaagcaggcgctgaacgcggcataattgatcggcaggttctcaccggataagatttcatcgcggtgcatatttgtaatcggcacttccgccgtcggaattaagaaataatcctcttctctgattttaaaagcatcctcttcaaatttaggaagctgtcccgtacctgtcatgctcgtacggtttaccatataaggaggaatgacttccgtgtaatcatattcatccacgtgaagatccagcataaagttgtagagcgcgcgttcgaggcgggcgcctaatcctttataaaacacaaaccggctgcctgttacttttgaagcgcgttcgaaatcaagaatgtttaagcggtctgcgatatcccaatgcggtttcggctcatatgaaaatgccggcgcctctccccacttgcgaatttcaatgttatcatcttccgtttctccgacgggaactgaatcgtgcgggatgttcggaatagacagaaggatggtttcgagcgtcgtttcgacagtacgaagctcttcatcaagcttcttaatttcttcgcctacttcacgcatctctttaataatatgatcagcgtcttttttctcccgtttcaaaacggcgacctgctgagacacctcattgcgttttcccttcagttcttctactttaccgataagctctcttctcttttcatccagctcttcaaacttgtcaaagtcagataagtcttcgccttttggaatgagcttcgcttttacctcttgaaaattggctctcagcaccttcgtatcaatcatgcctaacaactcctatctgtttttatcgaaaataaaaaagagccctcatcccctaaaagggacgagagctctcgcgttgccaccctgattgaaaacaagctcacacttgctttccgctttaacacataacggttttcccgtaaatgcctacttgttttcagcatttcgctcaaggacggattcggacagcatctttcaccgattcgcaccacccatcggctctctttgaaagaggggcttcctactgcttcctgtcaacgcttttcgatctttatttgtgattataatgtactataagtatcagcggttttcaactgttttatacagctgtttcctgcttatgcttttccgccatcttcacaaacagctctgtcacccggtgatcatccgtcagttcaggatggaacgagcagccgaggaaatttccctgctttgcagccacgatgcgtccgttatgctcacaaagcacttcaacatcttctccggcttttaaaatatgcggtgcgcgaataaatacacccgtaaacggctcatcaaggcctttaatcgtcagatcagcttcaaagctgtcgacctgacggccaaaggaattacgctcgacaactacgttcaacagccctaaatgagcgttatccgttcccgctatctctttggctaagataatcagaccggcgcatgtgccgaacatcggcttgccttgagcggcaaactcgcgaagcggctccataaaatgatacgtatccattaaacgccgcatcgtcgtgctttccccgcccggcaggattaagccgtcgatgtcattcagctgttcaggacgcttaatgacgacaccttttgaaccacatgcttcaattgaacgaatatgttctcttactgctccttgaagtccaagtacaccaattgttaacatgcttacagctctcctatggttttaccagccgcgttcttgcatacgctgttccggcaatagatttgagatttcgatgcctttcattgctgtgcctaattctttagaaagctcagcgatcagtttgtagtctgtataatgagtcgttgcttcaacaattgctttggcgaatttagcagggttgtctgatttgaaaatacctgaaccgacaaatacgccgtcagcgccaagctgcatcatcaatgccgcgtcagcaggcgtcgctactccgccggcagcaaagttcactacaggcagtttgccgtcacgtttgatctgaagaagcagttcataaggagcgccgaggtttttagcttcagtcatcagctcatcatcgctcatcgcaacaactttgcgcacttgcgcgtttacttttctcatatggcggacagcttccacaatgtttcctgttcccggttcgccttttgtacgaagcatggaagctccttcggcgatacggcgcgttgcttcgccgagatcacggcagccgcatacgaacgggactgtatattcatttttatttaaatgaaattcttcgtcagccggagtcagaacttcactttcatcgatgtaatctactcccattgcttcaaggacacgcgcttcaacgatatgtccgatacgcgcttttgccattacgggaatggatacagcattcattacttcttcaacgattgtcggatcagccatgcgggcaacaccgccggcagcgcgaatatcagccggaacgcgttctaacgccattacggcaacagctcccgcctcttccgcaatcttcgcttgttcagcatttactacgtccatgatgacgccgcctttttgcatttccgccatgccgcgttttacacgatcagtacctgtttgagccattatttggtccccctagtcaatgtatagttagataatgtctatctcttattgtatcccagaaatacaatatttcatatgggtattcttattttacagcgagatgaataagatagatatcatttttttactaataatttggttttttcagtatattaagcaaaagagccctaactttcatcagagctctttcttatttcttaaaaccagcctgttaccgtgtcaacggcgctgttccagataccggagaaaaatccgccgatgccgcgcatcatctgaacaaaccagtttgctttatctacatcatttttcgttacaagattcacgctgaactctttggatttgaggaagccatagtctttgtcactgcctttgtatgtaactgtcagcgttccgactttcgttccctttttcacaggagccgtgatttcttttttatctatagtcccttcggctttatagttcttttcatccccgcttttcacaggaatagaaagcgccttgtcagtaacaatatcgacttgcttgtctttccctttttcaacgtcaaccgttttgtgcccttttacttgagagccttcagggtaaagatctttcattgagaaattgctgttaaatgcgtaatcgagcatttttttcgtttcatcaaaacgtccggtatgcaggttgccttttgcgtttaatacaacggtgatgacccgcattccgttccgctgtgctgtgcttgtaaaacaagatcccgcagaatcagtagaacccgtttttaagccgtcaacgccagggtattcagaaacaagaccttttaacatgaagttccagttcggcatgtccatttcatcatcagtgccggctctgaatttcgttttagcgatgcttgttgttttgagaacttccggataatcagtgatcaggcggtctgcaagaagcgccatgtctttagcagaaacttcactctcttctttaacgccttctccttgcggctgtttgccgtgaagatcttcattcacaagccctgtggcatttttaaaatcatagtttgtcatgcctaattctttggctttcgcattcatttcagcgacaaatttcgtttcagttccggcaagaatttcggcaactgcaatcgcggctccgttagcagagtaaatcgccatggcctgatacagttctttaaccgtgtatttgccgtcttttcgaagggggacgtttgataaactgttgtcttgagaaatttcatagacataatcatcaggagtatacgtttgatcccatttcacttttccttctttaatggcttccagaagcagatattcagtcatcatttttgtcatgctggcaatcggcagtcttttgtctgcatttttactgtataaaatttttcccgatgaagcctcaatcattatcgcagctgatgcgttgacatcaatcgggtcattgccggctgcctccgctttagacatcggaacaaagcaagttgcggccagtgccagtaccactaatgacaccaacagctgtttccatttcgtgatgttcaatcttacgacctccgtcattcattttaaatctataattaagccgttaaggacatattcaaattcaaaacacaacagtataaattttatcacactcgatataaaaaaaatagacagagtcagcgaccctgtcaaatgttttttatttgtaacaattatgagattgtgtagtttggtgattctttcgtaatttggacatcatgcggatgactttcgcgaagaccggcacctgtcatacggatgaattgagcctcttctcttaaagcgcgcaagtcttttgaaccgcaatatcccatacctgaacgaagaccgccgacaagctgatacactgtttcttctacaggacctttgtacggagtccgtccttcgataccttcagggacgaatttcttattttcttcttggaaatatcggtctttactgcctttttccatggcagcaacagaacccataccgcgatacactttaaatcttctgccctgatagatttcagtctctcccgggctttctgaagtaccggcaagcaggcttccgagcattacggcatgtccgcctgaagccaacgctttcgtaatatctccggagaatttaataccgccgtctgcgataattgtcgcgccgtgttttctcgcttcagtggcacaatcataaatggcagtgatctgcggtacgcctacacctgcaacgacgcgtgtcgtacagatagaaccaggcccgattcccactttgacaatatttgctccggcttcaatcagagcttttgtcgcttcagccgttgcaacatttcctgcgataatgttcagttcaggatatgtttcacggattttcgcaactgtgttcagtacgcctctggaatgtccgtgagccgtatcaaccacgataacgtcgacattcgcttcaacaagcttgctgacgcgtgtcattgtatcgcctgtcacgcctaccgcagcgccgacaataaggcgtccgtgttcatctttagatgaattagggaattcgataaccttttcaatatctttgatcgtgataagaccttttaatttgttttggtcatccactaacggaagtttttcaattttatgtttctgtaagattttttctgcttcgtctaatgtggttcccacaggagccgtaaccagctcttcttttgtcatgacatcactgattttcattgaataatcagagataaagcgaagatcacggtttgtaatgataccgacaagcttttgatcgtctttattatctacgatcggaacaccggaaattctgtatttccccatcaaatgctccgcatcgaatacttgatgatcaggtgttaaaaagaagggatttgtaataacgccccgttcagaacgtttgactttgtcaacatgttcagcctgctgttcgatggacatgtttttatggataatgcccaagccgccctgtctggccatcgcaatcgccattgctgattctgttactgtatccattcccgcactgatgacaggaatattaagctttaacgtttttgtcagttcaacagataaatccacatcacgcggaagtacgtctgattgagccggtacgagcagtacatcatcgaacgttaagccttcttttgaaaatttactttcccacattagtaaatccccctcttttcggcaaaatattatatgtagattatcaactagaaaacagcatgtcaaggaagcgaaaaagagttgaaatatttagataaaggaaagggtttaaaaatacatatgagagatcatgagtggaaagagttatcattattttattccgtagaatcttcccagaaatttctaaacaaagtctatacagaaagcggcatggaagaaccaaaacgatatgcgtttaagaacagtgagcgcttcatattctttatcaaacacgccgagtccttttataagcaggcatctctttctcctttagaaattaagcctattctgttgttttacgggatgtcacaattgctgaaagcctgccttctgaccacagatccaagctacccaagccacgcttcagtactcgcgcatggcgtgactgcccggaaacgcaaaaagcaaaattactcctttagggatgatgaagtgaaggtgcagcgcaatggcttatgtattcatgtaatgaagcacttattcgggatagctggtcttgaggaagaacggtacacaatgaagaaattactgacagccatacctgaattgcatactgtcttttacttccaagagaaaaagaattggatgacccaagtagagctgaacgatgaccttatttcagtgcctgagcatgcggtgattcattacaatatgtctgattcccgctttgctgaatatatcagccatcatttgaagtggtcttttctgaggaaagaccataaccacttgttttttgaggctgacccgatagacagggaaccttggtcttctccaaatttattgtttcacttggagaaaaatcaatattacattccctctcagcgtgatcacttcctgcatcttccggaaatgattattcattatttggttctctacaatattgggatgattgcgagatatgaaacggagtggtggtatgaactgctgacacagcatgtcagtgatgattatgtgatgatccgacggttcttagaggtcacggaacgcaaatttccgtattacgtttctaaattcctgaagcaatacttgtaaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacaataagtatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaagttccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagaacttttccgcccctctcgaagcgacctcttaatcataacattttcagtttgctaggtcaatacttttttaaaaaatattttcgctaggcttgcctttctattaaaaagacaacaaaaagaattatatcagcatcatcaccatgtgtcaaagcttttttttatttctttatatagtaaaagcgcagcctgttgcagctgcgctttttcgtttatacttcttccgtttcttccggctcttcttcattcttttcgacaagcgccacagtggctacatgctcttgatcagacatgcggatcagacggacgccttgtgttacgcgtcccgtagtggagatatcattaatatccattctgattaacacgccgcttgccgtaataatcattaagtcctcttcgccttttgttgctttcacagttactaacggaccgttgctgtcagtgattttacatgttttaaggccttttccgccccggctttgaactctgtattctgaagccggtgtgcgtttgccgtagccgttttctgtcactatgaggacatgggagtcttcttcaagaatctccatgcctacaacgacatcatcgtctgtcagcgtgatacctttaacacccgcagctgtgcgtcccatttgtcttacatcttcttcagggaaacggatcagcaaaccgttcttcgttccgatgatgatttgtttcttgccgtcagtcaggcggacggccatcagttcatcgtcttcccggagacctagggcgatcagaccgttattccgtatattcgcaaactgggacagtgccgtacgtttcgacaccccttgtttggtcgtaaagaagaggtattgctcctcatcaaacgtgctgaccggaataatggcattaatccattcgcctttttcaacttccagaaggttaataatcggaatgccttttgccgtacggccgtattcagggatttcatatcctttagaacggtataccttccctttattagagaagaacagaatcgtatcgtgcgttgatgtggaaattaagtgttccacaaagtcatcttcattcgttcccattccctgtacgccttttccgccccgtttttggctgcggtatgtggacgccgggagacgtttaacatagccgttatgggtcagtgtgatgacgatattttctctctcgataagatcttcatcttcaattgtttcaagaccggacgtcacgatttcagtgcgtctctcatcattgaaacgctctttgatttcattaagttcttcacggatgatctcaagaactctttcttcattggctaaaatatctttcagctcagcgataagcgcaacaagtgattgatattcctcttcaatcttttcgcgctccagaccggttaatcgctgaaggcgcatatccagaatagcttgcgcttgtttttcagtcagtgagaattgttcgatcaaacccgttctcgcaatttcagccgtctgggaattgcggataagagaaataacggcatctaaatgatcgagagcaattcttaaaccttccagaatgtgagctcttgcttccgctttgcggagttcgtaagccgttctgcgccggatcacaaccttttggtgatcaagataatgctccagacattgtttcaggcttagtaccttcggctgtccgtcaacgagcgccagcagattgattccgaaagacgtctgcagggccgtttgtttgtacaggttattcaaaatgacgtgagcattggcgtcacggcggatctcaatgacgattctcattccgttacggtcggattcgtctcgcagatcggtaattccttcgatttttttgtctcggacaagatccgcgattttttcaattaatctcgctttgttcacctgataaggaagttccgtgacaataattctttcttttcccgatgaagtctcttcgatttcagccttagcccggatcgtgattgatccccgtccggattcatatgccttgcggatgccgctccggcccaaaatctgacctgcagtcggaaaatccgggcccgggatgtattccatcagctcctggtttgtaatctcaggattctcacttacggcaagcacgccttcaatgacttccccaagctgatgcggggaatgtttgtcgccattccgaccgcaataccggcagccccgtttacgagcagattcggaaatctcgaaggcatgacggcaggctctctttctgaaccgtcatagttatcttgatagtcaatcgtgtctttcgtaatgtcacgcagaatttccattgcgatttttgacattctcgcttctgtgtaacgcatcgcggccgctgagtcgccgtcaaccgaaccgaagttgccgtgtccgtcaacaagcatgtagcggtagttaaaatcctgcgccattctgaccattgattcgtaaaccgctgagtcaccgtgcgggtggtacttaccgataacttcaccgacgatacgggcagattttttatatggtttgtcactggtcatgcctaaatcattcattgcgtacaaaatccgtctgtgaaccggcttcagaccgtcacgcacatccggaagcgcccgggatacgataacgctcattgcatagtccaggaaggatgtccgcatttcctgactgatattgacttcacgtacttgtggtgtgttttgttcactcattaaaaaaacctccctgaagtatcacatgaaataatgtgggagtagattgtccattatgatcttcaatacgatttcactattctccattatatcaataaacttgtgtttatacacattaatttagtagaatatacgggttttgcgggttttcagaggctttagaagccgctttgagaaaaaagccttatttcttaacgaaaataaggctttcttggttaaatatcaagatttttcacgtatctggcgtttgcttctatgaagtttctccgcggttctactttgtcacccatcagcatttcaaaagtctcgtcagcgtccattgcatcttcaagattgacttgcagaagcgttctggtcgcagggtccattgtcgtttcccaaagctgagtcgcgttcatttctccaagacctttataacgctggaggccgggcttaggtgattgcggaagctcttttaacagctcatcaagctgcttatcgttataagcgtattccacccgttttccctgctgcactttataaagcggcggctgggcaatgtagacatagccgttttcgatgatttcccgcatgtatctgtagaagaacgttaataaaagcgttctgatatgggcgccgtcaacatcggcatccgtcatgatgaccactttatgataacgcgctttttcaagattaaaatcttctccgattcctgttccgagggccgtgatcattgatctgacctcattgtttgagagaatcttatcaagtctggctttctcaacgttcagaatcttaccgcgcagcggcagaatggcttggaaatgacggtcccgtccctgtttcgctgatccgcccgcagagtcaccctctacgatatacagctcggaaatgctcggatctttagaagaacagtccgccagtttgcccggcagattggaaatctcaagcgcacttttgcgccgggtcaattcccgggcttttttcgccgccatccgcgctcttgcggccattaaacctttttcaacgattttgcgggctgagtccggattttcaagaaggaatgtttccagcgcagaagaaaacagcgtatcagtgatcgttctcgcttcggagttgccgagcttggttttcgtctgcccttcgaattgcggatcagggtgcttaattgaaataatggcagtcagcccttctctcacatcatccccgcttaaattcggatcattttctttgaaaatcccttttcttcttgcatagtcgtttatgacacgggtcagaccggttttaaatccggcctcgtgcgtgccgccttcgtatgtgttgatattatttgtgaaagaataaatattgcttgtatagctgtcgttgtattgcaatgcaacttcaaccgttatgccgtctttctcgccttcgatataaatcggctcttcatgaacgacttctttggaacggtttaagtactcaacatagcttttgattccgccttcgtagtggtactcgtttttccgttcttgtccttcacgtttgtcttcaatcgtgatgtttacgccttttgtcaggaaggccaattcccggacacggtttgaaagcagatcatagtcatatacagttgtttctttgaaaatttccgggtccggaacgaagtgcgtaatcgttccggtcttatcagtttcgccgatcacttcaagatcggccacaggtacaccgcgctcgtacgcctgataatggatttttccgtcacgatgaaccgtaacgtcaagagtggtcgacaaggcgtttacgacggatgcccctacaccgtgaagaccgccggatactttatatccgcttccgtcaaatttaccgccggcgtggagaacggtcatgatgacttcaaccgcagggcggcccatcttctcctggataccgaccggaattccgcgcccgttgtccttaacggtaatgctgttatctttttcaatctcgatgttaatatctgtacaataaccggccagggcttcgtcaatactgttgtcgacgatttcccacaccaaatggtgaaggcctttgctgttagttgatccgatgtacatccccggtctctttcgaacagcttccaaaccttctaatacctgtatctgattctcatcataactattttgctgctgttccatagccatgcacattcacctacacttttcttaaacgataatatattcattgtaaagatccgctaagaatctatttctaacataaattgcgcacgtttcttcagtgtgccggaagataagggagagtaatatatattctcagtcgtgactacgatagactttggcgtgccgtttacggacggcactactttttctttctgtctgtccagaaattcttcaacgatcggcgatacattgaccttgcagtcaaaaatgccgacgatatcgcgggttgaaacgacaaagtcgtcacctaaatgaatatacaatcgctcacctcatttcttcacttcactaacgcaccgttttccacacggaacattcctgcttgatgtaaggtatcgtggtcaatgccatccacgctcgtcgtggtgacaaatgtctgcacacggccttggatcgtatgaagcaaatgggactgtcggtaatcatccagctcgcttagtacatcatccaaaagtaaaatggggtattctccgatttcttcatgaatcaaatctatttcagccagctttagagacaaagccgtcgtacgctgctgtccctgcgaaccgtaagtctgcacatcgcgtccgttcacataaaaaaggacatcatcccgatgcggtccgaataatgtgacgcctcgttctatttctttttcttttaatttcgaaaaagactcctggtagctgttacctattttcgacaaatctttgggatctgatacatcaagcgccgtgtgatacttaagcgtcagttcttcaagtccccgggaaatgccggaatggatcggctgcgcccatttttcaagctgcgccgtaaactgcagacgtctggcgacaacttttgcggctgcttcaatcagctgatcagtgagaacgtcaagcatggtccggtcagtctgtttccggctttgcagctgtttcagaaaatgattccgctgtgaaaggattttttgataaagagataaatcatacagataaacggcagaaacctgcccgatctccatatcgagaaatcttctcctcacctgagggcttcctttgacgagatttaaatcctcaggggcaaacataatggtgttcagcgctccgacatactgactgagtttttgctgctctatatgattgaccttgccctttttaccttttttggagatgacaagctgcatcgggatgtccccgttgcgcttcatcactcttccttctattttagcatagtcttcgtcccaccgtataagttctttgtcatttgaggtgcggtgtgattttgccatcgaaaggacatagatggcttccatcagattggttttgccctgggcattttccccgatgatcacattcaccttgttttcgaattgaagctcagcgcgctcataattacggtaggatgttaattctaaattttggatatacaaccgctgtcacccgctttaattgacgacttgaaatgaaccaaatccttcaatcgcgaccacgtctccaacgtaaagctttctgccgcggcgattgtcaggttcattgttgacagtcacctcatgctcgctcagaaaccacttcgccatgccgccggactgaatcacatcagctaattttaaaaactggccaagcgtaatcatttctgtatcaatcgaaatcggatttgccataatatcgacctctttcaaatatcactaatatctaattgtactaaaaaatcctgaaataaggaaagggaaaacttgagggagcggctgatgaatagaaaagctgccgaactaagccggcagcacattctgtttgattaatacgttctgaccggaaggatgagctgaacgatggtctcatcattcggcgtacggataagaaacggtctcatcgctcccgtaaagctgatacggatgtccgctccttcaagtactttcagtgcgtccatcatatattttggactgaatgaaatatttaattcctcgccgtcaatcttgtctgccagcacagcttcgaccactttcccgatttccggagaatttgatgaaatctcaagcgaatccgccggtttggcagaaagttttacaacgttgttgcggccttctctcgccaataaagaagcacggtctatcgcctgtaaaaattccttcgtgttcacgacgatttccgttttgctttcctgcggaattaagctggtcgtgtccggatagtttccgtcaagcaatcttgagaagaacaatacgtttttcgctttgaacagaacttgggtttctgtaatgacgatatccaccagctcttggctgtcatcaagaattttgcttagctcggttaagcttttcccgggaatgaccacgttataagtactgtcttccggaatatcaagcttcgcctttcttaaagcgagtcggtggctatccgtggcagtgcataataattcaccgttttcaactttccagtttacacctgtcaagatggggcgtgtttctgaggcggacacagcgaacacggtttggcggatcaggtttttcaaaagatccgtcggaatctgaatggcgtgatgctcttcgatttgcggtagatgcggatattcatctgcatcaaggccgtttaaattaaattcggcttttccggaacggataatcgttaaatattgattttgaacttcgatttcaacagtcgccatcggcagttttttaacgatttcgctgaagaaacgcgcttgcagcacgatacttcccggctgatcgatcgtcacgatttctttatcatcatcttctttcggaatgaatgactcaattgaaatatcagagtcacttcctgtgaaagatactccttcatctgaggcgacgatcttaataccggtgagaatgggaattgtggttctggatgaaacggcttttagaacgtcttgtacactttcgactaaccgatctttttgaatcgtaaatttcatgtttatcctcctaacggataatataattaatatatttttaaaaatagcagtagtaatagtagggcctgtggatttgtggataagttgtgaaaaagacaggaaacacagcctatccacatgtggacagactgtgtatggctatgaaaaagttattcacactttccccgattcatccgaggacactattatttaagcagttcttttatttctttcacctgctgctgaagctgctcgtcatcaatcagcagttttgaaatcttttcgtgggcgtgaatgacggttgtatggtctctcccgccaaattcttccccgattttaggcaaagaagaatccgtcatttctcttgaaagatacatcgcaatttgtcttgggaaagccactgatttcgtacgctttttcgctttgaaatcttcaagcttaatgttgaactgctgtccgacaatccgctgaatctcttttatcgtaatgaccttcggcttagaagacggaataatatctttcaatgcttctgcagccaggtctgcgttaatgtctttattgattaaggatgaataggcgacaacccggattaatgccccttccagttcgcggatgttgctgtcaatctgattggcgatgtaaagcatgacctcgttcggaatatcaaggccctccgccttcgctttctttctcagaatggcaatccgcgtttccagatccggcggtgtgatgtctgtaatcaatccccattcgaaccgcgaacgcaggcggtcttcaagggtcgggatctctttcggcggtctgtcactggaaatcacgatttgtttgctttcttcatgaagtgtgttgaatgtatggaaaaactcttcctgtgtttgttcttttccggctaaaaattgaatatcatctatcaaaagtacatcaacgttccggtagcggttgcggaaatcaacggctttattatcgcggattgagttgatgaattcatttgtgaatttttcagaagacaggtacaccactttggctgaaggattatgatcaatgacataatggccgatcgcgtgcattaagtgggtttttcctaaaccgactcccccgtatataaataaagggttgtacgctttagcgggtgcttccgccacagccagtgatgctgcatgggcgaatcggtttcccgatccgatgacgaatgtgtcgaatgtatatttcgggttgagcatgctttggggaaaatcagacggttcctcttttgccgcttttttcacttgcggtttcggcaaaaagtcttcttcgtcctgattttgaggaatgacaaatttgacgctcaattcttccccggttaattcatatatggtatctgcaatgagatgtaagtacctggactccagccagtctctggcaaattcattgggagcggtgatggttaaggtatctccttgcagcgaatgggctttcgtcgacttcatccaagtttcgaaactcggtttgcttagctttttctcaatttgagctagagcttgattccaaagatccaatatattctccattatccggcacagccctccttttctttaaaaatcagcgcccttcccctgttatagaacacaaaaaaagagcatatggctctgaccattcgtacacacgaaatgttgaaaacatatagtatagtagaaaaatagcttttcgacaaattccacaagttgtggacaacaatctacacaagctgtgtgaaaacaatccacaacttatccacaatttgtggataaagagaatggactggataagtaattaagagttaaaacacaaatataatatcaaattaagcgaggacttgcaatggttctcgtaatcttatccacaaacctgacaacttgttgaaaaatctttgtccacaggggttagcaatgtgaaaatgttgtcgataacgattgtggatattaaaaaaagaccgaaaaattatccacatgtcgttttttcgggggagcgcggctttttttgtgcgttaaaaaaaggaatatgaaaaataaggtttctaatctggttaaggtatgttatcctattatggttgtaagaaataaaagcactgctgaagttgacaatgaataggcagcacaaatataataagtaagactgtctttaacagctattcctcgagggaggtgtcataaatgaaaagaacattccaaccgaataaccgtaaacgcagtaaagttcatggcttcagaagccgtatgagttcaaaaaacggtcgtctagtattagcacgccgtcgccgcaaaggcagaaaagtattatcagcttaggccactgaataatgtcagtggtcttttttcacattaagagaaaagagatgtcatgcgtcgcccggtactggagaaatttcttcagtattccggcggcccgttttttttagatagaaataaaagtttctgcgagtgaatatcggagtgaattaaagtgaagaagcgaaatcggttaaagaaaaatgaagattttcaaaaagtgtttaaacgcggaacgtctatggcaaaccgccagttcgtgctgtatacgcttgatcagccgaaacaggaagagctccgggtagggctttctgtcagtaaaaaaatcggcaatgccgtcgtgcgcaatcgggtgaagcggttaatcaggcaggcggttcaggaggaaaaagagctgctcaagccgaaagattttattattatcgcaagaaaacccgccggcgacctcagttttgaagaaacgaaaaagagtctgcagcacttattcagaaaaacctcattatataagaaatcttcgtcaaaatagctcatattttgttttcttcacgtttttaaaagcgcttccttttatttggcgaaaaatgaacgccatttgaaactgaaagatgctaaaatacatacaaggtttataaagattggtataggaggaaacgttcttgaaaaggagaatatggttactactgagtatggtcggtatgctcgtgctgctggccgggtgctcgagtgtgaaagagccgattacggcgaatagtccgcatttctgggacaaatatgttgtgtatccattgtcagaagtcattacgtacgtagcgaaactgacgggcgataactatggtttgtcgatcatcatcgttacgattttaattcgtctgctgattctgccgctgatgatcaagcagcttcgaagctcaaaagcgatgcaggcgctgcagcctgaaatgcagaagctcagagaaaaatacagctctaaagatcaaaaaacgcagcagaagcttcagcaggaaacaatggccctgttttcaaagcacggggtaaacccgctggcgggatgtttcccgatcctgattcaaatgccgattttgatcggattctaccacgccattatgcgtacgcaagccatttcacagcacagctttttatggtttgatttaggagagaaggatccttactatattcttcctatcgttgccggtgtggccacttttgtccagcagaagctgatgatggcgggaaatccgactcagaatcctcaaatggcaatgatggtatggattatgccgatcatgatcatcgtatttgcgatcaacttcccgagcgcgctttctctgtattgggtagtcggaaacctgtttatgattgctcagacattccttattaaaggacctgacattaaacacgatccggaaacgcagaaagccggaggaaagaaaaagtgaagaaggtgactgctgcgggacggaatgtcgaagaagcagttcaatcaggccttcaggaacttcaactgacgaaagatcaagtagaaataacggtggtgcaagaagaatataaagggtttttgggtattttcggaaaaaagaatgcgattgtagaactggaagagaaaagaaatcctgttcaggaagcgaaagcgtatttagaagaaatcatccattccattgccgggccttctgagattgttacggaagaaaacaagaaaacagtctgttttcatattaaaggtgaaaaagcggcgctgcttattggcaaaagaggacaaacactcaatgccttggaaacattgacgcagcttgttttgaaccgcggctccggccagtatcgccaagccgttgtcgacgctgaaaattatcggcggaaaagaagagaaattctggatcagctggcaaacaggctggccaagcaagtgtcgaaaacgaaaaaagaggtgcatttagaaccgatgccgtcaggtgaaagaaaaatcatccatgacgcgctgtcaaagcatccaaatatcaaaacgttttctaccggtgaaggccggtaccgccatctcgttatttcccataaagatagcagaaaaccgaagtccgggtaaaatcggaacttcggtttttttattggtaaaaatggctctattcctgagcagaatcgcattttttgcgtttaagttttttctttttaggtctatgctgttgataaaaaaggttttaggaaataaaattaattgttattcacatgtggataagttaaagtaataagggatgaatttctgcctttgtggataacgtatcttccacttcaaaccaaactatgttatcttttaattttggcgtaaataaaattttttatatagatggaaacagagataaagagaggtgaacagtatggatacaattgcagcgatttcaactccgatgggtgaaggcgcgattgcgatcgttcggctgagcggcccggaagccgtaaagatcgccgacaaaatgtacaagggtccgaaaggcaaaacgctcagttcggcagaatcgcataccattcattacgggcatatcgcggacagtacgacgggacggattattgaggaagtcatggtgtctgttttaagagcgcccagaacattcacaagggaagatgtcattgaaatcaactgtcacgggggtattgtgacggttaatcaggtgctccagcttgctttaagagaaggtgcgagactggcagaacccggtgagtttacgaagcgcgcatttttaaacggacggattgacctttcacaggcggaagcggtgatggatctgatcagagccaaaacggaccgtgccatgaatgtcgccatgaaccagatggaaggacggctttccgcgcttgtccgccgtctgcgtgatgagttgttagaaacacttgcccatgttgaggtaaatatagattatccggaatatgatgacgtcgaagaaatgacgcatcagcttttagtggagaaggcaagcggcgtgaagaaagaaatcgaggcgctgctccgtacgtctgagcaggggaaaattttgcgtgagggactgtctaccgtgatcatcggccgtccgaacgtcgggaaatcctctctgcttaacagccttgtccatgaaacgaaggcgatcgtaaccgatattccgggaacgacgcgtgatgtgattgaggaatatgtcaacgtgcgaggcgtgccgcttcggcttgtcgataccgccggaatccgtgagacagaagacatcgtcgaaagaatcggtgtggaacggtcacggcaggttctgaaggaagcggatctcattttgcttgtgcttaaccacagcgaagcgctttctgaagaagatgtgaaattgtttgaagcggttgagggaatggacgtcattgtcattatgaataagacggaccttgaggctaagattgacgctgagcgcgtcaaggaactggcgaaaggccggcctgtcgtcacgacctcattgctgaaagaagaaggcattcaagatttagaggaagcgattcagtcgctattttatacaggagcgatcgaaagcggagatctcacctatgtcagcaacacccgtcatatttcgattctgcatcaggcaaagcaagcgattgatgatgcgctgaacgggattgaacaggatgttccgattgatatggtgcaaattgatttgacaaggtgctgggaactgctgggcgaaatcatcggtgatgccgttcacgaaagcttaattgatcagctcttttcacaattttgtttaggtaaataaaagggaggaaaaaaccatggggtatgaagcaggccaatacgacgtgattgtcatcggcgccgggcatgccggtgttgaggctgccctcgcatccgcgcgccagggagccaaaacgcttgttttgacgattaatcttgatatggttgcgtttatgccatgtaatccgtctgtcggcggccccgcgaaagggattgtcgtccgcgaaattgacgcgctcggcggagaaatggctagaaatatagataaaactcatattcaaatgagaatgctgaatacaggaaaaggtccggccgtacgggcgctgcgtgcgcaggcggataaattccaatatcagcacgaaatgaagcatacgctggaaaaaacaccgaatttgacacttcttcaagggattgccgagcgtttaatcattgaagacggagagtgccgcggtgtcattacgcaaaccggtgctgaatacaaggcaaaaacggtcgtgctgacaaccggaacgtatttaagagggcggatcattctcggggatctgtcttactcaagcggtccgaataaccagcagccgtctattaaactttctgagcacttagaggagctcggttttgatctcgtccgttttaaaacgggcacgcctcctcgtgtctcaagcgattccattgattacagcaaaacagaaatccagccgggggacccggttccgcgcgctttctcatatgaaacggttgaatacattaccgatcagctgccttgctggctgacttacacgagtcctgagactcatgagatcatcgacagcaacctgcatcgttcgccgatgtattccggtatgattaaaggaacgggaccgagatactgcccttcgattgaagataaagtcgttcggtttaatgataaaccgcgccatcagattttccttgagccggaaggcagaaatacgcaggaagtatacgttcagggtctatccacgagtcttcctgaggacgtgcagcagcggatgctggcgaccattccgggactggaaaaggtgcagatgatgagagccggatacgcgattgagtatgacgcgattgtaccgacgcagctctggcctacactggagacgaaaaaaatccctaacctgtacacagccggtcaaattaacggtacatcaggttatgaggaagcagccgggcaaggaattatggcagggatcaacgcaggccgcaaagcgcttggaaaagaagaagtgatcctcagccgttccgatgcttatatcggtgtattgattgatgatttggtaacgaaaggaaccaatgaaccgtatcgtctgctgacttcacgggcggaatacagactgctgctccgtcacgacaacgcggatcttcgcctgacggaaatcggccatgagatcggcttaatttctgatgagcgctatgaagcgtttgagaagaaaaaagcggcgatcgaggcagagaaaaaacgtctctggtctgttattatcaagccgtctcctgagaatcaggaatatatccgttcactcggcggaagcgagctgaaagacggagtgcgcggcacagatttaatgaaacgtccggaaatgaactatgaaacagtgacaaaacttgcgcctgcagattctccggttccgcaagatgtggcggaacaagtggaaattcaggtgaaatatgaaggatatatcgaaaaatccttgcagcaagtggaaaagctgaagaaaatggaaaacaaaaaaatccctgatcggattgattatgacgccattaaaggaattgctactgaagcgcgtcaaaagctgaaagaagtgcgtcctttatcagttgctcaagcgtcccgtatttccggcgtcaatccggcagacatttcaatcctgctggtatacctggagcagggccgtattgccaaggtagctgaatagaaaggatgacggcatgaatatagagcaatttacatccagtttagcggagaaagggatttccctttctgaccgccagctggagcaattcgagttgtattaccggatgctcgtggaatggaacgaaaaaatgaatctgacatccatcactgagaaaaaggaagtttatctcaagcatttttatgattcgataacggcggcattttatattgattttgaaaaggtcaccactctttgtgacgtcggcgccggcgccggttttccaagcctgcccgtcaaaatctgcttcccgcatctgcatgtcaccatcgtcgattcactgaataagcggattacgtttttggaaactctctctgatgctttacaattagagcatacgacatttgtccatgacagagcggagacattcggacagcggaaagacgtccgggaaagcttcgatctcgtgacggcccgtgcggtggcgcgtctgtcggtcctgagtgagctttgtctgccgctggccaagaaaaacggtatttttgcggcattaaaagctgcagccgctgatgaagagctgaaagcggggcaaaaggcgattaaagtattgggaggagagcttgaacaagttcattcctttacacttcccgttgaagaaagtgaacggaacattatgatcattcgcaagacgaaaagcactccgaaaaaatatccgagaaaaccgggtactccaaataaatcgccaattgaagggtaatttagacagcctgatgtgacaattccatcatattttctgcaaaattgatgaagatacagcaggaaaaaccatgagaaaatagaattataaaaatggcagtttttaaaggtggtgtaggtacatgaagcattcattctctcgtttcttcgggtttggtgagaaggaagaggaaccggagatagctgagcatgatacaaacaaagaagagatactcgaaataccggtacatgctatcgttcccaaccgttttcagccacgcaccattttctcagatgaaaaaatcaaagagttagcaatgactatccatacacacggcatcattcagccgattgttgtcagacatacagaagatgaaggacaatatgagctcattgcgggtgaaaggcgctggagagcggtacagacgcttgaatgggagaagattcccgcaattattaaagatttttctgatacggaaacagcatctgtcgctttgattgaaaacctgcaaagggaagaattgtcctccattgaggaagctcatgcgtacgcaaggctgttagaacttcatgatttaacacaggaagccttggcgcagcgcttaggaaaaggccagtcaacgattgcgaacaagctccgattgttaaagctcccggaacccgtccaggatgcgattatggagaaaaaaattacggaacgtcatgcaagagcactgattccgctcaaacagccggagtttcaggtcacattgcttgcggaaatcattgagaaaagcttaaacgtcaagcagacagaagacagagtggtgaaaatgcttgaacagaataagcagaaaccaaagccgagacgcaaagcgttcagcagggatacaagaattgcgatgaatacgattcgtcagtcactgtccatggtggaagacagcggcgtcaggctgaacactgaagaagaagaattcgaagagtacatccagcttaccattcggatacctaaataaaaactctcctgatcagcaggggagtttttattttaatcaaaaaactattttgagataatgatagatttattgtgcactatacattatatatgtaaaattttatctttttgtgtcgtgaattgtctttttacagtcaaaaaagtcactttatcggagaacttatattagaaagtgtctttttcgtttacatttttttcacttgctgataaacaaattatgaaaaaaataaaacgctttactctttttttgataagatagaaacaagacagtacatgttcatgtgaaggtaggtgacatcgtgggaaaaatcatagcaattacgaaccaaaaaggcggagtcgggaagacgacgacttctgtcaatctgggggcttgcttggcttacataggtaaaagggttcttcttgttgatattgatccgcagggcaatgcaacgagcggattagggattgaaaaagccgatgtggatcattgtgtgtacgacattttagtagatgatgcagatgttacagatattattaaaccgacttcagtagagaacttagatgtcattccggccacgatccagcttgcgggagcggaaatcgaattggttccgacgatctcacgggaggtcaggctgaaaagagcattagaatctgtgaaacaaaattacgattacatgattattgattgtcctccgtctctcgggttattaacgattaatgcgcttaccgcttcagattcagtcgttatcccggttcagtgcgaatactacgctcttgaaggattgagtcaattattaaatacagttcggcttgtgcaaaaacatttaaataccgacttaatgatagaaggagtgcttctgacgatgcttgatgccagaacgaatctcggcattcaagtgatagaagaggtaaagaaatactttagagataaagtgtatcaaaccattattcctcgcaatgtccgtttaagtgaggcgccgagtcacggcaagccgatcatattatacgatccgcgttcgagaggtgcggaagtatatttagatttagcaaaggaagtggcagcgaatggctaaaggcgggctcggaaaagggattaacgcgttgtttaatcaggttgatttgtctgaagagacagtggaagaaattaaaatcagtgatttacgccccaatccttatcagccaagaaaacaatttgatgatgagtcattagctgaactgaaggaatccatcattcagcatggcattcttcagcccattatcgtgagaaaatcattgaagggctatgatattgtagccggcgaacgccgttaccgcgccgcaaaacttgccggtaaagagacagtgccggctatcgtgcgggatttatctgaatcgctgatgcgggaaatcgctcttttggaaaaccttcagcgtgaagacttatcaccgcttgaagaagctctggcatatgactcactgctgaagcatttggatttaacccaggaacagctcgctaaacggctcgggaaaagcaggcctcatattgccaaccatttaagactgctgacgctgccggaaagcatccagaacctcattgcagaaggtacgttatccatgggacacggcagaaccttgcttggcttgaaaaataaaaacaagcttgaaccgcttgtgaagaaagtggttgaagaacagctgaacgtccgccagcttgagcagctgattcagcagttaaacaacaatgttccacgtgaaacaaagaaaaaagaacctgttcaagatgttgtgttaaaagagcgggaatcgtatttgcaaaattacttcggaacaacagtcaatattaagagacaaaagaaaaaagggaagattgagattgagtttttctcaaatgaagatcttgaacgtatcctggaactattgtccgaaagagaagcgtaaaaaccatcttttttaaaaaagatggttttttatatacgtcttgtcagcttatgaaacggactgagccgttcctgccggccttctgatttatctgtcagctgtaacccctctgctaaaacatttgccatgctcataacaagatgaagcctcgtattctgcaggacaaaatactccataaacccgctgacattgacgattccattgatatggacgtcaccgatttcaggaaggtctttttgaacacctgctccgggcttcagcggcccatcgccgatttgaaatgagcctacgcttttgacgcggcctaaacaagcatcaaccgctataataaacggatttttatgtagatgttgaatatctttcagcttgtctttcatattgacggcgtgaacaggatctgacagcgtgccgtaaacgtgcaatctgcctaaattcattttttctaactttgttcctacgagcggacctaatgaatctccggtcgaccgatctgtaccgatacacacggtgactaacggtctgccggctgctttacgtaaagatgaagtaaggattgcttgtatttgattcgcagcagaagaatccgtatgggatacatattgttttgcccgttcttgagaaaaaagcccgccttttcgattcataaggttcacttccttgtcatgtcatacgagtattacattgttgtttttggtgatgtatggttgtttacagtatatccagcgctgcctttttttatgcttatgtcatgatgagcatgccggttgtttgaaaagagcggatagaaaaaagaactcagagcagttattctctaagttcatgaaagaaataagaccatatgatctacatcaacatattgctgatgatctaattccagcgctcttttttctgcagagaagaggataatcctaactgagcgcagagtttttttgcgggttccatttgttgaagtaacagagagatggagctgttctgtgtctttcatcttttttgcccggctgatggcttccgtcattaaagcttttcccgcgcctgaccctaggtgtttgggggaaatatacatagaaccgataaccgcaatgtgtcttagtttaaacagcagatgcttggagatcttgaggattcctatcaggctgtcttgttcaaaggcgccaagcaagatggcattgccggcttcaagcctggctttgcatttttcggacggcctcatagctgacggcgattgcgtccgggtgatcttttaaagctttgagcctgaatcggagtaaggctgggtatcacttgcggttaaacgcctgatgtccatgatttgagcgcctaacataaataaattttctgaatagtcaatcgtcgttatcataccatatttgtcccatttgtatgaatgtttgctgctgtcactcaatatagtagcaatatgcggagatgatcagaaattttatgaggtgatgagggtgtggagagccgggatgaagtggatgctgctcatattaagcagccagattggggccgggtatgcaagcgggcaggaaatatggcagtttttcggtgtcgaaagcggactggctattgtattgtttacagtcatgtttacgatttcggcttatattgtgttgaagatcagctatcgggttcaatcaacgcactttttacctgtgcttgagcatctgatgggaccggctcttgctaaagtctatgatgtgcttattatgttttatttgttttcaatgacgatggttatgattgccggcggcggtgtgacgctgcaaatgtacaagctgccgttttggatcggtatttttcttctttgcattgtgaccgtgggtttattcttttgggatataaaagggatattatctctgaatagtattttgataccgattcttgtagcggggctgttatatgcattggtcttttttcagacaacgcatcattacacgtggacgatagacttgacccgccagtataattggccggcaagcattaccttcacgtccttaaacattctttctgttgtcgctgttctttcttcaatcgggaaagatatgaagggactgggagaagccaaaatcgcaagcgttgcaagcgggctgattttcggtatgatttcatttgtttacaatgaaacgcttgtacagctttcaggcagtcttacacaatatgagattcctcttttcgccgtccttgaaggcgctccttatccgttatttctttgtatggccgccgtgctttttttagccatctatacgacaacggtgaccggtcttttcgggctgtccagccgcatgcttgcatttgtgaaattgccgagatggacgctcgtatctcttcttttagctgtgatggtgccttttacgacaatcggtttttcagatttgatcgccattttatatcccatttacgggcttttaagtctttatttgctggtatgtcttcttctttaccctattttagggagatggaaaaaagtataatgctcattttgagtgcggccgttgctcttatcctgtctttttttgtacaataaataaagcagtctatggagagaggtgaagggtcttggcggataaagactttggcctgaatgatattgttgaaatgaagaaaccgcatccttgcggtgaaaacaggtggaaaatcattcggatgggaatggatattcggatcaaatgcacgggttgttcccacagtgtcatgattccgagaagagattttgagagaaagctgaaaaaagtactcgtcaagcatgaggagcctacatcataagggctggcgctcatgctttttcatatagaggagaggaagaggcccgatgagcaaagtgcatcagtcagcgtgcccgctgaattgctgggacagctgcggctttttggtgacagttgaggatggaaaggtgacgaaagtagacggagacccgaatcatcccattacggaagggaaaatttgcggccggggcagaatgctggagacgaaaacgaatgcgccggaacggcttcgttttcctttaaaaaagaaagacggcgaatttgtccgcatttcctgggagcaggcgttagatgaaattgctgaaaaaatgacggtgattaaggagacgttgggcactgccgcagtgctgcacagtcatgactacgccaataacggtcttttgaaggcgctcgaccagcgttttttcaatggatacggcggtgtaaccgagattgcgggcagcatttgctggggttccggcattgaagcgcagcgctgggatttcgggcgttcttacgggcatggaccgcttgatatttatcacagcaagcatgtgatcgtatggggcagaaacgtgtcccggacgaatatgcacctctatcatcatctgcagcaggtgaagaaaaaaggagcgacactgacggtcattgaccctatttttaacccgactgcaaagcttgccgaccggtatatatccgtcaaacccggcatggatggctggcttgcggcgggtgttttaaaaatattatgccaaaccggcagaaccgattctgattttattcaaaagcattcggtcggttttgaggaaatagacaagcttctgcagacgatttcttttgaggagatcattgagaaaacagaaacgtctttagaagcgcttgaatatcttgccgatttatatgctgacggtcccgcctccacttttatgggtcttgggatgcagagatataaaaacgggggcgggacgatacggtggattgacgctttagctgcggcgagcggaaatgtcggtatcaaaggcggcggcgccaacttcggaaatgtgcaagtcggtgaaagctttgcaaaggccgagctcactcgtcctgatttgaagaaaagttcgagaacgttttcgatgatgactcaagctgaagaggcgctgaatgcagccgacccgccgattgagatgatcatcgtgacgtgcggcaatccgctgacacaggtgccgaatacaaaaaaagtgaaggaagcgtttgaaaaaacgccggtcacagtggccattgattcggtcatgaccgatacggcgaagctctgtgactatgtgctgccgacggccgttgttttcgaagaggaagatatttattattccagcatgtatcatcactatgttcaatatggtaagaagcttgcggaaccgcagggagaggcaaaatcagaccgctggatctggacggaactcgcaaagcgtctcggattcggggagctgtttgattacagtgcggaagatttcttaaaaatggggctctcttctttggagaaagaaggaatcacccttgagcaattaaaggaaaaaggacatatgccgcttccggttaaacaggttccgtggagtgattttcaatttttaaccccgagcggaaaatttgaattcgtctcgtcactggcagaagagaaaggatacagcggcctccctcaattggaagtgccggaggagtccgtttatcacgacgccggactggccgggaaatatccgtatacgctgctgtccattcacccgcagcgctccaatcattcacagcacgtgccgtttattgaaaagctccagcagattcaggtggacctgtcgccggatatcgccgaggagctttcacttcaagacggagatacggcagaggtatacaatgaccgcggccgtctgcgcggcagggtgaaaatcatgaagcaggctcacccgaagacggtgaatatagatgaaggcatgtgggcggcattcggaggctccgtcaacatgctcacaaaggattcaaattccgataatggaatgggaagtacgctttttgactgtctggtagcggttaaaaaagggtaatctaaggagagagagggcgggaaatgcttttttctcagcttgtcttttcctatgaacctccttataattgctctaggtttacaatacgtttatacgatgatggtttgatatagaggagatgaaagaatggctttaactgctggaattgtcggtttgccgaatgtcggaaaatcgacgttatttaatgcaattacccaggctggtgccgaatcagccaactacccgttctgtacaattgatccgaacgtgggaatcgtggaagtgccggatgaacgtctgcaaaagctgactgaattggtgaacccgaaaaaaacagtgccgactgcgtttgaattcactgatatcgcggggatcgtaaaaggcgcatctaaaggtgaaggactcggaaataagtttctttctcatatccgtcaggttgatgcgatctgccacgttgtacgtgcattcgctgatgacaatattacgcacgtgtcagggaaagtcgatccgattgacgatattgaaacgatcaatcttgaattgattcttgccgacatggagacagtcgaaaaacgcatcacgcgtgtaagcaagcttgcgaagcaaaaagacaaagaagcggtttttgaatttgacattctgtctaaattgaaagaagctttcgaacaagaaaagcctgcccgttccgttgaatttacggaagaacagcaaaagcttgtgaagcagcttcatttgcttacgtcaaaacccgtgctttatgtggcgaatgtaagcgaagatgaagtggctgatccttcagacaatgaatacgttgcgaaaatccgtgagtacgccgcgggtgaaaatgccgaagttatcgtcgtctgtgcgaaaattgagtctgaaattgctgaattggaaggcgaagaaaagcaaatgttccttgaggagctcggcatcgaagaatcaggtcttgatcagctgattaaagcgtcatactctcttctcggccttgcgacatactttacggcgggcgaacaggaagtgcgcgcatggacattcagaaaaggcatgaaagctcctgagtgtgcgggtatcatccacactgactttgaacgcggctttatccgcgctgaaacggttgcttatgaagaccttttggcaggcggcggaatgtccggagcgaaagaagccggaaaagtgcgtctggaaggtaaggaatatgtagtccaagacggagatgtcattcatttccgatttaatgtataggacacagttgtaaagggacaagagctttggtataatataaacttgtgagtaatagaattattgctccttgcccattatagggccgcttagaccaaaaggaggtgcaaacagatgaaaaagtacgaagttatgtacattatccgtccgaacattgacgaagagtcaaagaaggcagttatcgagcgtttcaacaacgtattgacttctaacggagcggagatcactggaacaaaagattggggtaaacgtcgtcttgcttacgaaatcaacgatttccgtgacggtttctaccaaatcttaaacgttcagtctgaagctgcagcggttgctgaattcgaccgtttagctaagatcagtgacgatatcattcgccacatcgttgttaaagaagaagaataagcaatttgaaatatataatgttaaaaggtggtctttcatatgcttaaccgagttgtattagtcggaagactgacaaaagacccagagcttcgttatacgccaagcggtgcggctgtcgccacgtttactcttgctgtgaatcgtacattcacgaaccagtccggagaacgtgaagccgatttcattaattgtgtcacttggagaagacaagccgaaaacgttgcaaactttcttaaaaaaggaagccttgccggcgtagacggccgactccagacaagaaattatgaaaatcagcagggacagcgtgtcttcgtgacagaagtccaagctgaaagtgttcaatttcttgagcctaaaaacagcggcggttctggatcaggcggatacaacgaaggaaacagcggcggaggccaatactttggcggaggccaaaatgataatccgttcggcggaaatcagaacaaccagagacgaaatcaagggaacagctttaatgatgatccatttgccaacgacggcaagccgattgacatctcggatgatgatcttccgttctaatagattatcgctatattcataacgagaaaggtgggaaatgacaatggcaggaggacgcagaggcggtcgtgcgaaacgccgtaaggtttgttacttcacttctaacggcattacgcacatcgattacaaagatgtagatcttcttagaaagtttgtttctgagcgtggtaaaatcttacctcgccgtgtaactggaacaaacgcgaaataccaacgtaaattgactatcgcgatcaaacgcgcacgtcaaatggctttacttccatacgtaactggcgagtaagccgaaagaaaagagcaagagcctgcgggctcctgctctttttttatatcagtcctcctccatcctgccgaaatgtttcacatgaaacatggaagtgctcctgacatctatctttgttatcttgctcctctattcaaatacgcgtacttatgcaatgaatttgtttatactgaagaacagggggtggctgagatggagacagacagaaatatcctgactgatgaaaagtggagcgcaatcatacgcaatgatgcttcttatgacggggcattttattatgcagtaaagacgacggggattttctgccggccttcttgtaaatcgagagctccgaataaagaaaacgtgctggtgtttgatacggctgatgcagcgcttgataaacattttcgtccctgtaaaaggtgccggccgaacggtcttcgtcttcctgatgaagaatggattgctcaaatcattgagtacattgaccgccattatcacgaatctctgactctgagtgtactggccgaaatgtgtcacggcagcccttatcatttacagcggacatttaaaaaaatcaggggaatatccccgattgagtatatacagaacataagattggcgaaggcggaacaccttttaaagcatactgatatgacagtcatggagattgctctgacggtcggaattccaaacacagcgcattttgccactctttttaaaaagagaaccgggaattcgcccacagaataccgaaaaactgccggaatgggacagggaggttcaatatgagtaaagagacaatggtctattggacacttttcacacggaatgattggagcctgtatacagccgccacatctaaagggctttgctttataggttcaaatcatggaagctttgaagagcttgagcagtgggcaaaaaaatcactgccgcaataccgattggcacgtgatgatgagaagctggcgtcttacacggcagagctgtccgagtacatcgaaaatggcagatcagctttttcagtgccggtggatctttacgggacagaatttcagcttgctgtatggaaagcgcttatggacataccgtacggcgagacatactcctattcggatatagcagaaatgattcagaaaccggcagccgtaagagccgtgggcgccgcaatcgggaaaaatccggtattgattacggttccgtgccatcgcgtcatcggaaaaaacggaaaactgaccggattcagaggcggtttagaaatgaaaaagcagatgctggcattagagggcggaaacattgaaacactggaatgccggctgagccggacaggggggaacacatgaaactgatttcttggaatgtaaacggcttacgtgccgtgatgaaaaagatagatatcaatacttacgttcaggaaacgaaagccgatattttatgtctgcaagaaacgaaagtacaggacggacaagtatcattacagcttgaagggtatcatgactattggaactacgcggtgaaaaaaggctactcaggcacggctgttttttcgaaagaaaagccgcttcacgtgttttatggactgggaattgacgatcatgatcaagaaggacgggtgatcacacttgaatttgagaacctgttcgtcgtcaactgttatacgccgaatgccaaacgcggattagagcgaattgattaccgtcttcaatgggaagccgattttaaggagtatctgcagaagcttgaccggaagaagcccgtgatattatgcggcgatctgaatgtcgcacacagggagatagatttaaaaaatccgaaagccaaccggaagaacgccggtttctcggatcaggagcgggaagcgttcagcgccctgctgaacaccggatttaccgactcattccgctatttatatcctgatcgggaaggcgcctattcctggtggtcttacaggacgaacgcacgtgagaaaaacatcggctggcggcttgattacgtcattgtttcagacagactgaagccgcggatcagcgaagcggccatttgcgccgatatcatgggttctgaccattgccctgttgaaatgacagtggatttatgatgagatagcagtaagagaaatccactcttgctgcttttttatcaccaaaaatggaggagcacatggcaaatataaaagagattgcgaaactggcgaatgtgtcggtggctaccgtatcacgcgtattaaaccgacacccgtacgtatctgaggagaaaaggcgtcttgtgaatcaagtgatgaaggagatggattatacccctaatcgaaccgccattgatctgattcgaggaaagaccaatacaatcggcgtgattttgccgtacagcgaccatccctgctttgacaaaattgtaaacggtatcacgaaggaagcgtttgcccatgattacgtgacaacccttctccccaccaactatgaccccgctatagagatgacctatttcgaactgctgaaaatgaaaaagattgacggactgattgtcacgtcccgcgcgaatgaatgggaaaccgctgtgccttatctggagtacggtcccattgtcgcttgtgaatatacgcagcatcaagagattccctgcgcttataatgacaggcaggcagcttacagagaaagctttttgtatttgaaaaaccgcgggcatcaagatgttgcttttacatgtgtgcgggaagcggaaaaaagcccgagtacggccgacaaggtaaccgcatataaggcggttttcggctctcttgatgaaacccgcattctgatcggatgccatgatatggacgacggaaagcgggcaggtgaacacttctggggtttccacaaggcgccgacggccatctatgcgcacagtgatgatgtggctgccggcttgtaccagtttgcgaaagaacagaaatgggacgcggagatcatcggcgagggaaacctgagcgtcagccgggcattgaatatcccatctctggaacttcatttggaacgggtcggaagggaagcatttttgctgtttttgcacggagaaacggctaaaaaacaaattatgcatcaatttcagcggaaaaagtcttgagctgaaatgggtttcatgctttataactagattgagaaaaaaaaaggaggcggacatatgcgaattgaacatgcggccatatgggtgaaagatttagaacggatgaaagaattttatgagaaatacttcggcgccaaggccaatgacctttatcataatgagaaaaaagatttcaaatcgtattttctttcgtttgactccggatgcaggctggaacttatgaaaaaaggcggcattgatgaagctccgtcacagaatatgaccggatgggcgcatctcgcattttctacaggcagcaaggagcgggtgaatgaattgacggagacgtttaaaaatgacggatttcaggttgtaagcggcccgcgcgtgacgggtgacggatattatgagagcgtgatagaggatggggaaggcaatttgatagaaatcacagtgtaacagtgcgggggaacccgcactgttttattgattaaatttgctgagcattagttttcggaccgaatagaattaacaaaacggaacatagaagccagcagccgccgatgaacaaaaagacgctgatgtagccgagcttaacggcaataaatccgacgagcagggatccgaatatattggaaaaacggccgagcccgtatgccagcccgctcccggccgagcgatattccgtaggatacggctccgatgtatatgcgtataagtttgaggtgaaaacccgttccgtgacattgacgacaaatccaaacacaataatcatgacgggaataaacgtcatgccgtataacagtccggcaatggcagtcagaaaagcgcttgcggccagaatccattttctttggaacgtctcggatatcatggaaccgagcaatgcgccaagcggtgcgccgacagagtgaagcacattgtaccacagcgttttttccatggtgatgccgttgcttttcagcaggctgggcacccatgaagcaaagccgtaaaagccaaaggtttcaagaatccataccgctgacaggatgatggtgatctttaaattcctgccctgaaacagccctaagtagcctgcgtgcttcactgtatgtacttctgccgcctcttttggcgcgggaagcgggcctttttctttctctatacgtgcttcaagacggttcataatggcgtttgcctgatcatatgcgccccgattttcgtgccagcgcggcgattcctcaagccggcggataaaaaagaaataaatgagaccggccgccccccatacgaatacgagccgccacccccatgagcctaaaggaatgacaaaagcggaaacaacgtttgtgacgggaacgccgatcagtccgatcatggcgcaaaaggagatgtattttcctcgtacggatgatggaaaaaattccgccaaatagctgttcgtcacaatcatggcggccgcgacgccgagcccggtcaagaagcggaaaatcattaaggacggaatgtcccatgccagcgcattcagaaaagatgagatcgaaaagacaaggacaaaacaattcagcgcttttttcctgccgatccgatcggacagtcttccgccgatggaggcgcctaaaaacatgcccaggaaggatgcggctgtgacgtcggcaatgacggacagcttcacgccccaatgctcaatcagcgccggagccacgttgctgagcgtaaacagatcagcgagatcgaaaaaatagatgattccgagagcggttaatacttgatagtgcacacgcgaaatggggagacggtctaatcggttcgctacatttgagaatgtctgatgtttcataaaaaaccccctgacttagcaattgtaatcagaaaatactgtaaatttatctgacgaatacattataaaggtctttttttggcaaaaacagagtgtaaataaccagagccaaaggaaacggcatagcgctttcttcttaaaatatataacatttcctatatctgtttctgtttatattgtaaaatgttgaaggaaaggaagttgatgcataaatatgaatacatttgtacggcccgcagagggaagaaatagtgtatcgagatatcttctttctctgttgctcattgtgggtttgttctttttcggaagcatactgaccgtgttttatatgtttctcacgtccgctttcaatccttcactgacgataaattgggatgaggcggcattaagtgacccgctggcggatatttatttacagcatatcgtctatttcatagcgattccgggcatttggatagcggttcgtttcattatgaagcggcggtttttatccatcattacaccgaatcagtcgctgaactggaagagaattttctttggattcggcacatatgttgtgctgatgtttgtcgcggggctgattgattttttaattcatccggatcgtttcacgcttcaggaattccatgcttcacgttttctgctgctgttagcggcggccgtcttgttggtgccgattcaaacctctgcggaggaatttctctttcgcggttttctgcttcagtttgccggaaaattgacggcaaacgcggtggttctgacggtcattatcggcggattattcggcgcacttcatttcggaaatccggagatggaaaatggagctctctgggcgggaatcggatatgttaccatcggcatgatctggacctttatcacgattaaaacgggcagtctggagatgtcccttggcggtcacgctgccaataatatgtttttatttatctttctcacagaggatcattcggtatacggcggcattccgtcgatatttacaacagcagccggcggctatgaaatatacgattgcatatcgactctggtgatcaacatcatcttcgcatggctcgcattccgttttgtgaaaaaagaaaagcagcaggccgcctaggctctgctgctgatttgtaaggtgttcatcgcttcatcaatatccgtcgtcggcctccggcaggcgaaattctcacaaatgtagaccgttgtcttcccatcgatcatttgataacccgcggcaaagtcagaaatgccggcaagctcatccggatgttctgcggcgagaatcgtataggcgggagtgaaatgctcctgaagcgcctcaatgaaacgttttctgtccgggtcatctttccttccgaacacaacgatttctttttggggcattgtgtgtgccagtacgctttgcatgaagaaagcgctgctgctcggataggcctctatttcccgtttgaacacggaaaacatcgcttcggctttttcaatcagtgatacatcacccgtcaggcggccgagacgaagcaactgtacggcagccgcgctgtttccggaaggcacggctccgtcataaacctctttttccctgacaagaagagtctcggcatcattccccgtaaagaaaaaacctccgtgccgttcatcccagaacagctccagcatgcttgtacataacgttttcgctttctgcagataagacggatgaaaacccgcttcatacaattcaaggtaagcccagatgagaaaagcgtaatcatcgataaaccctttgtttttcacttcgccctcgcggtatcggaccatgacgcgcccgtccggcatgaggtgacgttcgagaaagcggatcgctgtttccgccatgctgagaaagtcaggctcgtgaaatacctttgcggcttttgccagcccggcaatcatgagcgcgttccatgaggtcagcactttgtcatctgtatgcggatagcttctgttttcacgcgcttccagcaattttgttcttgcctcttcaaggcgttcggccagctcatgtccggtgaggccggtctcttcgaggatggcctcacgccgcgtgaaaatgaggtgcgggatgttttcgccttcaaaattgccttgatctgtgatgttatacaccttgcaataaagcgggccgagttcatcaccgagaagattcatgatttcttttttggaccatatgtaatatttcccctcacggccttcggtatcagcatctaaagctgagaaaaagctgccgtcttcatgcatcatttcccgctgaataaacgttacgatctgcatcgcaatctgtttgtagcgctcattacccgtgacttgataggcttccgtataggcggtcaggagaagggcgttgtcatacagcattttctcaaaatgcggcacgagccattcattatcagtcgagtagcgggcgaatccgaacccgatgtgatcaaaaattccgccgttcgccatgccgtcgagtgtcttggttacgccggccaaagcctgttccttgcccgtatagctgtagtagcgaagcagaaacatgagcatatgcggcatcggaaatttcggagcctggccgaacccgccgtacaccgtgtcaaacccgccggccagctggcgatacgtgtcatgaaccgcctgttcgccaagcatgccctcagccgggtgaatcttgacttcaagatgagcggcggcgttttcggcgatatcctcgacatgctgccggtcattcgcaaacgtttcggacagatgttcaagcacatcaataaagcccggacggttaaatttgctcgtcttcggaaaatacgtccccgcataaaacggcttctgatctggtgtgacgaacacgttcagcggccacccgccctgccccgtcatcagctggcagattctcatatacacggaatccacatcaggccgctcttcacgatcaaccttgatggctatgaatttatcgtttaacataccggcgatctcttcgtcctcaaaggactcgtgagccattacatggcaccaatgacaagtcgaatagccgatgctgacaagaaccggcttgttttcgcgttttgctttttcgaaggcttcttctccccaagggtgccagtttacggggttgtgggcgtgttgaagtaaatatggagatttctcagcgattaatctattgggtgtactgttatttggcattggatcaccttctttcacttttaaattggttgctatttttactttaccataatggagtttagtttataccttattagattaactagattagattttatctactcgtctaaggaacaccagtcattttgcgcacaatttttttgcaaaataaagacttataaacatttgctgtttcttgtaaagtggtaactaataaagaaataatgaaacaaacgatagaggtttagtacaaatttataagacgttgattatttatacaggaggagagaattaacaatggcatatttatatttattgctcgcaatttttggtgaacttattggttcctctatgctcaaggccgcagaaggcttcacgaaactttaccctactattggtgcaattattgcttttataggttcctttttcttcttatcacttgcaatgaagtccatacctttgaataccgcctatgcagtttggtctggtgtagggactattgctactacaataatttcgattttgatttggaaagaaaaaattaacattgccagtgttactgggattgttttgatacttgtaggagttgtaatattaaatctttttggacctggtcatggtgaagcacatagtgttgaaaacgcaagcgcaacaacaaacaatgaaaaaataattgagtagtgaactgtttgatagtgaagtctataaaacctcacttttttatttatagtcatataatatttgaatgtcatcatctttcatgaaaagtaaagtctcttcgtttttaagttgttcaattgcttcattgactgtttgatccaatttagatttgggtctgtccttttcttctctaccgaccaaaaaatcagtggatacatcatataaatcagcgagtttctttaatgtctccggatcgggcgatctataatccctttcgtaattagacaatgtctaccctgttaatccaattttctctgctggcacgtcttgattagagtaaccggatttttttcgagcccattttaatctttggcctaatgtcatttgttatcatccattccacaaagagttgattaattattataatatcagcaattgctgaccctttcataaagtagaacaaaaaggcgaacattaacctttgactctccgaatcggagggttaaacttaatctgtagttttattcattttgttgtctcgtccatactttcgtaaaaattctccgaaggcatcttgaagcacaaaaaagctctgactaattaatttagtcagagcttttttttatgaagtattcccgagtatctgtccttgtttttttaggcaatactacgtccaattctttatttaaccatgcgagcgttttattacgaagataattacgcatctgttcttctgcttcaagcattaccaagttaattgtacaagaagaattgctggattcacaagagttgcatttgtctcgataaagtagaccattgcttacaatatttttacattggaaaatgggttttggtccttcaacagcctctattacatcccaaaaggaaatatcctccggggattttgctaacctatatcctccctttacaccagggacagaatttacaataccagctttagataatttaccgaaaacttttgaaagaaatgtttctgaaagtccttggaactctgcaaggtcccgaatcccgacactttccttggagggaacatctattaaataaaccagacaatgtaaagcatattcaaccccaacactgtactgcatataaactcacctgcttttgattttaaggtttatcacattgtatcttaggagtatttttgatgatagtcaatcttaaaacccttcttcagatactatttgttccgtttgacaaaataaaatacaaggtttatattagtgaccaagttaatcgtcgattaatatagtctttaatataaaatgaaaggagagtttcaaatgagcaaaacacttatcattaacgcacatccaaaagtagatgatacgtcatcatacagtctacgggtaatgaaccactttttagaggcttacaaagaattaattccagagagtgaagagcttgagcaaattaacttatatagtgatgatgtgcctatgattgataaaacagttttaagtgcatgggataaggcagaaaaatgcgaagaactgacaagcgatgaacaaaaagtaacaggacgcatgacagaagtattgaaacaattcaaaagtgcaaaaacgtatgtcattgttttgcctttgcataatttcaatattccatcaaaattaaaagactatatggacaatattatgatcgcacgtgaaacatttagatatactgacactgggtcagtaggtctgcttaaagatggacgaagaatgcttgtcatacaagctagcggatcaatttatacaaatgatgactggtatgaagaagttgaatactcaaataaatatctgaaatcaatgttcaatttcctcggtattgaggattatcaaattatccgagtgcaaggaacagctttactgagtccggaggatgttttacaaaaagcaaataaagaagttgaagaagctgcttcaagattggcaggtaaataaggtatagcatgaagatcattgttgctgggggactgcagtaattggtcggtcccttcttcctaaattaatacaaaacggccatcaagtatttgcattgacccgaggtaaccggtcgaacacgttcctcaaaagaataggggtaactcctgtaaaagcagatgcaatggatcgagatgctgttcttaatgcttttaggaaaatttaacctgaggttgttgtccatcagtttacctctttaacaggttacaatcttgaagaaaaagcgagaatcagaattataggtgcgcgaaatactgttgatgcgtgtcatgaaattggagtgaagaggataattgctcaaagtctttcttttgcttatgaacccggattaatacctgccaatgaagacgtccctttagatctcgacgcaccaaatccaaggaaaataaatgtaattggagtggcatcattagaatcagcagttgctgaattacccgatttagtaaacaacattaaaacattgcaagaaaatgggttgaacaatatctcatttgaagtaaatcatgacacgttagagcatctttccagcgtgtttttttatttgtgaaaatgaaaaacctgtcaagaaacaaaagacatacaataatcgcaataaaaacgaaaagaataatttaatcaatagacactttgtacctttttacattttaactttgtcaataaatgttcaatctgccatgtaaattttcaaaattctttacgggagtgggggaatttgcttgcaacaagttttcttgaacaaaggtaacgcccacaaccccgtaaactggcacccttggggagaagaagccttcgaaacccaagtattaaaaaggagaactgcttatgactctattttcagggttaaatgtcatctgctttattgctttttagataagaaataaggatttaaaatctttatctttttatttactgttagataggtgaaacacaccccggcgactgtaaccatcccgcctgtcagtgcaataaacgcaggtacttcacctaaccacacccaagaaatagccaaggctacggctggtgttaaataaagtgaaatggctgcttctgaagcaccgacgagtgaagtgacatacgcaagtgcaaagtaaggcacaaccgttggtaataagcctaagtaaacgacagaccatgtggaattcatcgatgcgtgaacaacttctccccataaccccggaagaaataccagcattggcaatgtcccgccccaaatagtgaatgtaacgaatgggataaatccatatttttttatatagcgggcttgaaaaacgaaataaatactctccgaaaaagctgccagcaagattaacaaaatgccgttcactgaatttgtatagtttcctgccccaaatgaaatgatcgatacacccaataaactaatgatagagccgacccatttataaaaaccgaaatgttcaccaaaaaacagacgggataacattgcagaaaaaataggtgtcatggtcacgagtaagcttgctacccctgcgctgacgtttttttctccgatattcagcaaaatgtgatatagtgcaaaacctaaaaatcctaacgataaaatagcagggatatccttcatgtcaggcaaacgcatatgagtcaaaacagcaaaaaccaccaatgccattgacccaatcaacaagcgaaacaaagcgaggtgttccggcgtgtaactctccaaactcgcgcgaattcccgggaaagctgatgcccacaacccaatcatcagactgtaagctatgccgattcgaactgttttctttctcatctttctcactcctctttacaaaaaccaaccagttatttaatgtttttctatattaataaagatttgatgagatgacttcaaccagttaaatagattttgacccaaccactttaaggaggacccttttaatgagcgctccagaagaaaaaaagatgagaaagcttcctaagtacatacaaatcattcaatttataaaagagaaaataggaaatggagaatggccgatcggaagtaagattccaagccagcgcacgcttgccaaacactttgaggtgaacaggagcacagtcattacagctttagaggaattgacggcggatggattaatcgaaggcagaatgggcaaagggacagttgttacgaacaatacatggacacttttggctaagaattccgctcccgattgggatcagtatgtaacctccggaattcagcagccaagccaaaaaatcgttcaagagatcaataaatcagaatcaaattctgatcttatacagctcagtaaaggagaactttcacatgagatttttcctttagctgttatgaaagagatcatgggaaaggtatcccaaaacatagaggcattcggatatgaggaaccaaaaggatatttgcctttgagagaggcattaagcggctatttaagaacaatcggcattcaagcttctccttcttccattcttattgtttcgggcgcactgcaagccttacagcttatatcaatggggcttttacaaaggggatcgaccgtttatcttgatcagccttcctatctttattcattacacgtatttcaatcagccggtatgaagctgactggagttcctatggatcatgatggacttttgccggaacatatccgcatggcaaggggagaacgggggagggctatcttatatacaaatccttgttttcataatccgacaggtattttaatgtcaaaaaagagacgagaagaaatccttgcggcaagtgagaatacacagcttcccattattgaagatgacatttatcgtgagttatggatagatgagattcccccggatcctattaaaacaatagataaaaatgggcatgtgctttacataggcagtttatcgaaaacattaagtccgggcttgaggattggctggattgtcgggccggaaccagtgattgaacgtttatccgacataaaaatgcaaacagattacggctccagttcgttatcccagagagtagcggcagagtggtttatatccggtgaataccagcagcatctagaacaggtgagaagtcaattaaaggtgagaagagaattggccttgagtgttttagaaactcatttgaaagatgtggcgacatggaatatcccaaagggaggattctttgtctgggtaaaaatattgccttccatatccgtgaaattactttataccaaagccttatcaaaagggattctgctcaatctcggcaggatctatgctgaggaaaaagggagttatattcgcttatcatatgcttatgcatctcttgaagaccttcaaaagggaatttatgaattgggtttgatgattaaggaattggcaagcagataaatttatcataattactttaatagaaagagacatgacaccaatgacacgcggattgttcgctgactacggttggggtgctggttaaaaaatacttaggagaacttgatattcaaagagctgtaagagagagattatctttaaaaccgtcactagcagaagtcttcaaaattatttaagttaatataccggtctttattgagatttgttttaaatatgcatttgaaggtcaattttatgatgactaagaactaagaattacactactttataaccgtaatttattaatgaaatatttcctgaaaaactttgatttttaattgcagattgatataataggtttgttattcttggccaaggatgagaatatttacaaatcttcaaaaagtggtgttagcaattaaaaaacctcatattttattatttatattaatttttacattaggtttttttgcgtgctttttattcatttttaagcatatagagagaaatgaaacagaaaaaattaatcataaccgtgtacaagaagtaccatggggagtgaaaaaaatcaatgctgcttcaatatggactttaagagagaaacagaaagtgaaagttgctatattagacagtggtattgataaagagcataaagatttaaaagggaaaattaaaggggaatttaatccaataaacatgactttaacctcagatgatgatgtggggcatggaactgctattgcaggcattatagcagctaaagataatagctttggattagttggaattgctccagacactgagatatattcagttaaagtactaaattcagaaggaaaaggttcgctagatacccttgttaaaggtatagagtggtgtattgataataatattcaggtaataaatttgagttttggattaaccaaagataaaccgttgttaagaggtgcaattgataaagcagtaaacagtgggatcataatcgttgcagccgcaggtaacaattatggcggggatgttgattatccagcagcttatgaaaaagttctctctattaatgctgtagatagaaataataaactagctaacttttcacctaaaggaaagattgacttttctgcacctggtgtagatataccgatactatccctcaataatggatataaaactgaaagtggtacatctttagcagctgcacatgttaccggagtaatatcattaattttacaaaatagagataaattcggaattgattcaaaagaggatatttataatcaagttaaccgtgtattgtccaaattgtccatcgatcttggaaagaaagggagagatgaaatttatggaaaaggatttttatcttttaagtaaaggggctaatttcaatgaaatgttttaaaaagagtattgctgtttttttaagtctaatattaacttttacttttattttacataatgaatcaaaagctgaggctataaacaataggtattaccaaattgtaacaaatgatgaagagaaattagtaatcacagcagaaaaaggcggagttaaaggtttaatgactttagataaagaaaatatgaaactttcattaataaccgatgaaacttctcagaagactggagaaaaaggtaaagaatataaagttgatattgaaaatgctacaaatgagaagatagaagcaacttttactgatacggaaacaaataaaaagtatgagattaattcagatgaggtaacagcttcttttgtttggtttatacctataggaatagttattggagaggcacttttagcgcatttaatttcaattggattagctgtgactatttcaggagtgacttatgttgcctattctgagtttaagaagcgtaaaagaacctattctcattatatggcagtaagaaagtctaaaggattatttatcggtaatggtttgaaaagacctgctgcaattgcacgccttaaaaggggtgatgacacttggtctacgtcgaagaacaatgccaaatctattgctaaagccgcaagtccgattaaaaaaattgttggtccggagatagataaaaagggtaaaggtaaacattatcattatcactcgatctctaggtataaacatggaaaaggtgtccgtatgaaagctcatgctttctatggggcagcaagataatttagattaatttataaacacctaactttaaagtaattaaaagataggaaattataataggagaaggaggtaactatgttaattattgatcacaacccaaaggatcagctgtattcagagttaattgatttggctttcgagatttgcgacgaatttcatttagttttaagaaaagatatgggatctttaaaatcattcgatcctctgttaaaaaaacttgaaagttcgttaaaagtaatgaaagagcaatcagaatgggccagtaccattctaggagacaatcaaaaagcaaaagtttattactattatacagatgaaaacgcaaaaaacattctgaaagaatccgcaaattctttatattcttgggagcagccacatttaccagaagacttgtctttttttaaagatggaaaggagtggttggtaacatgctctcatgaagaagaaagttatatcgatactgaagatgataaagaaatacaaagaatattgagtataccaggattaaaagtgcattttgaaagatgggattaaaatcattcaattttttataaaaaaattgaatgattttagtgaataatatatataagtaaggaaaccgtatagaatggtttccttacttattaaaccaacattactcaattgggatttttcttgtttatttcttgactaatacatattgtttatcttccaaatagaatatatgactaaggtgatttatatctttaaactttatatgttttccaaattgtaaagtatttaaattgataactacacccatgctttcatctttatcttcatcttcatatccatctaagcaggaatatatttcaattgattcaccttttgacaagtgtttttcaatgaaaagaaaaagtgatttaatagatttacgttggccaggtgtattgttggcatgtaagtacccttgtaattcatatatataaggatgtgtgaatttgtttctgactgcttcatatccaggatctaaatgaacaatatcaattccgtatgcatcttcttctgtgtcataaacctttacaagtgaattttcactgttctttcgattgtttttaaattgagagcgtttgttgacatctccttttatttttagttcagaaatgggcttaagtgtaggattactgccatactcaccaataggaagttctttatccgccccaataaaatgatgtaaagtcaatctatttcctcctttatcttatacaactaaaaatactcaatctgactttggataatgagatcttttttgtgtgtctatgataccccgtgtttcttgcctcatcaaggcttgataatgtttgaaggctgaagatggatgatgtgactgatttttaggctccttagggaaagaggaaccgaattaatttaatttaattgttatattgttgacgcatactccatcaatgtccatttagatggtatttttacagctgcagatttttcttcgactatttctaatgttctttcaagttgattatatatgtatccggaaaattaagtataccgtttgaccaatttcagcgttatgaagatttcgttgccagaataccaacaattgaagataaattgaagcagaatagtattaattctaaaaagtgcgggcgcattatggggagaggggaatcttacacacttatctgcagcttcacccacatactttgtgaaagctccaacagcttcttcgcattctgcaagacaacaactattccgttgctttttaacattttcacattacaggattcaggataaaaaagccgccaacagggcggcttttcttaagttaatataccaaatatatatcaaacttcaatctgtatagctatgtctttcctaaaaaaccatcggcttggttcttgaagagtaaatcatttaacccaaagcactattactcctgcagatgaaatttagattattgggctgtatagccgccatccattacgacggcctgccctgtaactccattagctttgtcactggcgaggaatactgcgtaatcagcgatttcttgcacggctaacaaacgtttttgaggaaccaaggggtaaatgacttcttcaaacaccttttctatagaaatgcctctagtctctgcaatatcttgtaactggttttgtaccaatggagtgtcgatatatcccggacacaaggcattgacagtaattccgtattccgctccttctaatgctgatactttagttaaaccgatcaaaccgtgtttagcgctgcaataagctgctttccctgcaaaaccaattaaaccatttatggaagccatattgatgatgcggccaaatttttgttttttcatcaaagggaacgctctttttgtcgcactaaaaggagcagtaatcattaatttcagcataaattcaaatttatcagtcgggaagttttctatatcagacacatgctgaatccccgcattgtttaccagaatatccattcgcccaaaggtttcaagtgtcttagagaaacttttttcaacttgttcttcgtttgttacatcacaaaccgcaggcaggacttcatatccttgtcccttaagttcctcagctgcatgatgcacggctttttcgttcaaatcggaaattaccacttttgcgccttctttagcgaattcacgtgcaatttctaaaccaattccgctagccgcgcctgtcacaagagcaactttactttctaataatttactcatagtaacccctccaggaaacattttggtctcctaaaagtttacacccggcagttgtataagtaaaatgaataaaaagaatataatgtattcgttaaactcatgaaatggagatcatacgatggatatacgccaaatcacatactttcttgaagttgctaaatccaacagttttactaaggcatcagaaaatctgcatttgtcacagcctgccttaagtaagatggttaaaagtttggaagaggaattaaaggttgatctcattgatcgatccgctagacaaatcgctttgacagatgcgggcgaaattgtatttgagcaaggccaaatgattatgaagtcattagatgacttgtcgacgaacttatacgatcttttgcatttaaaaaaaggaaaagtgaaaattggaataccgccgctgatcggtgtcttgttttttcctaaaatcattagagggtttaaacaattgtatcctgatgtgaacatcaagctgatagaacatggaggaaacaaggtgaaaaaggaggttgaagatggagtactggatcttggcgtggttattgaaccagtggacaaagagcagtttgatatcattccattgcttaatgaagaactgatgctcttcgttcattccgctcacccgcttgttcataaagagattgtggaaatgcaagacttgaaaaatgaacctttcatcctgtttagtgaagacttttctcttcacgatcggattattcaggagtgtattagagccggttttcgtccaaatattgtttatgaaagttctcaatgggattttatcagcgaaatgattggagaagaactaggtatttccattttccctcagtcgatagtgaaaaagactgatcaaagtttagttaaggcaatctccattgtcaatccatccattccttggaaagtggcgattattttaaaaaaaggaaaatacgtttcacacgcagtacgcgaatttatccggtatatttcatctttttgtaagagtaattacgtagactaagatcactcatgaaaaaaatgaatggtttttatagtttttatgtattttacggttagagagggctgcgatatattatcttatgtcaggaaataagtacctttcaggaggaatttcaaatggatcaaagccgttaccagcaaggtttagacaaattaatggagtacactttaacaaacgatgataaaatttctacgcatttaaagatttctgaagacttgaaagatatcgctccagatgtaagtaagtacattatagaatttgcttacggagatatatattcacgaccgggattaaccaatcaacaacgtgcgcttgttaccatttcatcccttgtaacgcaaggaaccgagccgcagcttgaacttcatatcaatacagggcttacatccggattaacaccgactgagattgtagagagtatcacccaattggttccttatacaggcttcccgcgtgtacttaatgctctttcagtagctaagaaggtgtttgcacagcggcatgtagaaagccattgagaaataaagagcttgtatggaatgcgggatgaagtagtataaactcatcaatagaatatacacaaaacgacagcctataaggctgtttttaacacaaatgtctgacctcttttttgttttcggctgatcatatgtaaaagcgattatatgaatcgctttttgatacttagaaacatgctaaccttcgacctctttatcagtaagcacttttaaagcatttcttacttttaaggcgaagttgacaggtttatcaatcgcttcgaaatgaatatacatcagtctcggtttgtcaaacagccagtgattgtgtagagacgttacaatcagatcatgtttccgaagagcgctgataaatggattgatttctttttgcagaattacagtttctccgctgcaaagagcacggccgtcttttgtcattgattcaaatgaaaacatttgcggaatgagcaaaaatgatcttccgggccgtcccagtacaaccggttttatattcgttcgtgatctcattactgtacaaattccattttcaaacgtatgcatggttccgcccagaatatcgttgaattcgtcacaaagaccatgccgttcaatcatttccccgtcagtttttggtaccgcacgcacagttttagtagtcagaactcttagggcctctcttacttttcttgcaaaattgagaggtttgtcaattgattcaaaatgcataaacatcagacgcggtttatcaaacagccaatggttatgaacggcagttacgatgataccgaatttgcgcagttcactcattaatgggttcacttcttcttgcagtaaaacagtctcacctaaacataaggctctgccttccgagtccatgctctcaaatgaaaaggcctgaggaataaaaggaaatgcctcggctcttcttccgagtaccaccgggtgaatgttgcttcgaaatcttgtcgccgtacatacgccatttacgacactgggcgttgaattgagaattcttgcaaattctttgcagagtcgtgatggctccatactcgtttcttccacttcatatctcctcctgaaatcaatttaaacgtacttaatagtaaagatatgtgaagatagaaaaaatgtaacgcggcaggagtccataatagagagaatcagcttttttcaccatctcttcaactgttaattattaatagattttaatcggactatttaagatgtgataaaagccttccggatgtgtttgtccattcagtttacattgggtgatgcctttttcttttaccatgttttctcattcgcttatgattactttgcccaacccgtatttgcggtaaggcttcaggatgcagattcgttcgagcttgcctgtttggtttacgatgcggatccgtcctgtgccggcaggctgattctcatgataaaccaagacatgcccgcactgttccccaagcgtatcgaactgatcaaattcatcggattcaggtacttgctgttcctcaatgaatactgcttttctaatctcaagcgctgcttgtaaatcaatttctgttgtatcctcatgatcaaccaacccttttcacatattagtctggactgcacggcttgcttgtggtcttatagaagtaacgacgaaacatttatattgcaagtgcaacaaaaatatgaagggtttgaaaagatatgactgatattttgcgtgaaatcggcatgatcgcacgggcattggattccatcagcaatattgaatttaaagaattagacttaacaaaagggcagtatctctatcttgtgcgtatatgtgaaaacccgggagtgatacaggaaaaactggcggaaatgattaaagttgaccgaacaacagcggcgagagcgatcaaaaaactggaaatacaaggatttgttgaaaagcgtcctgatgatcaaaataaaaaaataaaaaaactgttcccgaccgaaaaagggagaaaggtttatccgttattgcaaagagaaggagagcactctgcggaagtagcactgtccggctttacgtctgaggaaaaagaaaccattttcagccttcttcagcgggtgagaaaaaatatagagcatgattgggaatatgtgaagaagggaaacaaaagagactattaatggatgataattccttttactgaatgattgcgttgtgaatgattaaagtcataaatggatacgttatctgtgaaatctccttcctcggttcctgcttcaactagccgataggcttatttttaacgaaaagtatcaattatggtatatttaaataagacaaaataattgaagcggggaatgatatgagtacaatcgaaaaacaaagacgtaagaaattcagagccaaatcaatcgtacgggtcatcatggtcatcatcggcggaattattgccgcgtatggactggaaaccgtactgattccgaatagtgtatctgacggcggtgtaaccgggctcagcattgtcggttcacagctgtttcatttgcctcttgggatcttgattgcggtgatcaatataccgtttgtctggttaggatataagcaaatcgggaaaggttttgcgtttctatcaattatcggtattgtctcacttgccgcgggcacgagttttttccaccacacgccggctatcattgagggagataccctgttaatcaccgttgtcggcgggattattctcggcttgggaatgggattggcattgcgcaacggcggcgccttagatggaattgatatgctggctgtgcttctgtcacggaaattgccgtttggcacgagcgatctcattttatttttaaacatttttgtgtttatttttgtttcttttgtattcgggctgcaaggcgcattgctttccgtcattgcttactacatcgcatccaaggtgatccatgtggttgaggaaggcttaagcggttctaaaacatttcagattatcaccaacgagcctgcattaatggtagagaccattcgtgaagaattgggccggagcgctacgtataaagaagcatacggcggtttttctcatgaaaaattcaaagaaatcacatgtgtcatcaaccgtttggaagaaaccaaactgaaggaaattattaatgacattgataatcaagcctttgtgacggtatatgatgtcgctgaagtaaaaggcagtaatttcagaaaaatccataatcattaagaaggagctgccgttcaccggcagctttttttaaaaaggagaaaacacttgcaaaaaaagaataacggatgtatattattgatatatcaaacattgactagtcaattaattgcgcaaaagaaagtagggatgggttttgacagcatgttgttcagaggaaggcgagattttgtatcagctccaatcactgcacaaagtgatcggcacgaagtttgaagcgtgcaccggaatcagccaatcccgccttgagcttctcgccgtgcttttttacgtcgatgagatcagccaaagcgatcttcagaaaaaggtgaatattgacggcgcagctgtgacaagacacttgaaacagcttgaagccaaagaaatggtcacaagaaggcggaagcctgaggacaaccgaattatacttgtccggcttactgatcaggggcgggagagaattgaggcttccaaaaaggagaaggagcgtttcataaaggaaatgcttgccggtgtcagcgaggaagaacgcagtatgttaaaaaacgtattgtcgcagatgcagaataatatagaaaatatgaaagcataggagtgtattacacatgaaaacagaactgaaaacaaacgattttatggacattatgaaaggccgccgttccattcggaattacgatccggctgtaaaaatcagcaaagaagaaatgactcaaatattggaagaagcaacgacagcgccgtcttcagttaacgcgcagccatggcgtttcctcgtcattgacagccctgaaggaaaagaaaaactcgcgccgcttgccagctttaaccaaacacaggtcagcacatcatctgcggtgatcgcggttttcgcagatatgaacagtgatgactatttagaagaaatttattcaaaagcggtcgagctgggctacatgccgcaggaagtaaaagacagacaaatcgctgcgttgacggcgcattttgaaaaactgccggagcaagtgaaccgtgaaacgattctgatcgacggaggtcttgtttccatgcagctgatgcttacggcacgcgcgcacggctatgatacaaacccgatcggcggctatgataaagaaaagattgccgaggttttcggaatggataaagagcgttatgtaccggtcatgctgttatcaatcggaaaagcggcagacgaaggatatgcttcctaccgtcttcctatcgaaacaatcgcacaatggaaataaggttgaagtgaagctgagaggagagggacagtggacataattgcggctgttttcgtcggaattgtagctttagaacatatatttatcatgatacttgaaatgttttttatcaattcgaaggctgccaagcggtctttcaaattgccgaagcatttagaaggcgatcggaatgtggcggtcatgtttgcaaatcaaggtctgtataatggatttctggctgccggcctcatttggggactgatcctcggagctgatccgattggccatatgattcaaatgtttttcgtcatctgtgtggtcatcgcggccattttcggaggctttacttcaaacaaatcaattatcgtaaaacaaggacttccggctgttttagcgcttatttttcttttattggcgtagcagacggagtgagtgagggcttccggaaaggaagccctctttttttattctgttttgaaaatcatttcttatatacatcactatagattggggatgtcaaatcagctgtcaccccttcttaattgttatttgctgaaagtcttctatctgctaataaagcctaatagatggagtggactccatgtcaatctgtttttttaaaaaaagctgatcggtaaatatggtatgatttacataatcagggagtggggttgcagaggatgaatatgaagagagcgtattacgctattttatacagccagaccgctatcaacttggggttttcactttatacgatggccgtcatcttgtttttgtttacaaaaaccggttcgacggcgatggcctctcttatgacgctcgtcagcattgtatgccgcgtattgggcagcgccgttttgccgctggtcaccggtcggttcacgcttcgttctttgttaatcagttctcaattgatacagatcacactgttagtctgtttgttttttgtcatccaaaccggttcatccgcattcttttttctgctgttttgtctgatcggaggcatttctttttgcaacggatggtttgctccgataaaaagcgcgctgattggggaaatcattcctcctgatcgaagggcgaaagcgaacagtttattatcggcggcggatcagaccgttcagtttgcggggtggtctctgggcggcgtcatcatagcgttcctgggagagagcgatacaatgatcgtcactgtcatgttattggtttcttcggtgttgggcatcattctgtttcttcaagtacgcatgtgtgcgccggcagcagtcagggaacgttccctttttgcagatgcggcaagcggctgggtgtatttatttcagcaaaaacagctcaaggttctcattgtgatggatgtgatcgaatcgtgggcaggcatgatatggatcgggtctgtgtccttaacttatgtgcatgacgtccttcataaaggagaggcttggtgggggtatgtcaacggagtctattatgcagggacgatgatcggcggactgatcatctataagttatccggtaagcttcagcatcatctcattccgcttatgctgacgggagccttggcatatggaatgttcacgtttatttacgggctgatcacaagcgccgttacggccctttttctggtgctgtgtatggggccggcttgtgtattacgagatctcacgcaggaaacattacttcaaaatatcacgaccgaaaagacacgggtcaatatattagcggcgagatcagctttagttcagttcatttttatgttttccattatcggaacggggattatctcggatgtattcggcgtgcggtttatttatattggcgcaggccttctcttattaatttcggcttttatcggattttctcagctgcgaatgaagaaaatggtacagagcggcatgtagtgtagtataattaggaacgtacgttctatatcgagagaggagagggtaatgtgggacatctggcactgcaattgtatgattatcatctttgggcaaatcagcaaatattcacccggcttaaagagcttccggaggatgtgtaccgtaaggagattcaaagtgtctttccgtcgatagccggtgtattgactcatgtgtatctgtcggataaggggtggtttgatgtgttctccggagagcgtctggaggatacgctgaaatcagctgaacagcaaaaagaggacatcttgtctaaagagatagaagagctggaagatctatttttgaaattatcagaccggtatcaactatttttgcagaaggaggaaaatatcagcctcccccttgaaatagagcatccgtcaggtgacatcatgaaaaccgcagcggccgatatgatcctccatgttgtgaaccacggaacgtatcatcgcgggaatataacagccatgctcagacagatggggtatgcttctgtgccgacggattacggtatttatttatatataaacaaaaagtaaacaagacaggcaacgcggctgtcttgtgatatccgtaaaaaagccaaatcatatgagtgatttggctttttcgtttgctatgccatgttttgcagccgttctaaactgtttttccaattcgcttcaagcgctgtaaaagcagcggcggcatcttgctgttctaatgcgtgaatgatatcagagtgttcattatatgatctgtttaaagcgccgttttcactgaaatagcggatttccagtctctgaattttgactttcaggcttactagcaatttgtgaagttcagcgttgtccgcaagcagaatgatgcgatggtgaaatgcattatccgcttccagaacggccattttatcgccgtctttcatcgtttgaagaagattttcattcagctgtttcaattcttgaatcacggcatcgtccatacgcgggagggcttgctgcaatgcgagtttctcaagcgtccagacgatggaatacaagttttccgcttcttttaactcaatcggagcgacaagtgtccatctgttcgcttttgttatcaccaagccgtcatcttccagccgcaataaggcttcccgtatcggggtgcggctgattcccaatgtttccgacaaatccttgtcctttaactttgtttccggtttgagcttgcccgttatgatccagtttctgagtgtgcgatacacttcgtcccgcatgatggttcttttcagcacaggttctttgttttgattatccaatggaacacctcatgaatcgtagtatacatatttgcattttaccacagtccgggcgccggttagaaatgaagagggacgtctaagaatgaatcgaaccgagatgcttcatctcaatatgctgaaagtcagcggagccgccttcagaaaagagcgtgattccctgatcttcgtgttttgggaacacttcatttgtcaaaacggtttttccgtcgtctgcaaatacttcaatacttgttttatccacgagaattttcagatgaacgcgccctttgtttccgtcaaatggggctttgctttcggtgtatgcaccggttttatcaggctggtctgtaaacgatctgttcacataggcacaaccgtcttctgctgaaataccgacatcaatatgccggctttggtctgctgattctctgagtctgacgcctgcatttttgatatctgaccaagcgatatccatatcaagctgatatgtatcacctttgatcggcagtgtctctgaaccgttcacctgtttgtgttctatgctgtcagttgaagaagttaattggttcaatgcttcaaccggctctgacacaaggctgtatgtgccgccgtcctgctgctgaagacggatttcacggacgatagaatccgtgccgttaaagccgttttttagtgtcggtgtttcattcggataatcccaattgttcatccatgccagcgcatagcgttttgtcagcggatcttcgctattaccgtcttcaaatgtgacgccgccgtaccagtcaaagccgtaatcaagccattgcggttcttcttgatcggcggtaaattccttcccgtcaaagtttccggtccaatacgcgtacgtattcggtttgcctgcgggtttgccgtttgcgcttgcgcccagaacccacttggctgtgccgtcatctgcacgcatcatataaaggtcggggcattcgatgaggccgatctgctgagtgataaaaccgcccgtgtatttccaattttttaaatcgggtgattcataaaaaccgattttttctccttcggccatggccatcacccatttgtcatcctgttcatcccagatcactttcgggtcccggaaatccttagttcccgggtttttcataacgggctgatcactataggaagtaaacgtttttcctttatccgtgctgtaccataaatattgttcctgggcttttgttttggctgtcggctgcgttgtgacggcgaccagcgcgtttttgccgaagcccgcggtgttgtgtttatcaatgacgacagaaccggaccagatatcgccgttttcgttggtgtatttcggaatagccgtgccttcgtccgtccagtgcaccaagtcctttgatacggcgtgccgccattctgtgccgttgccgttcgggtaatcccgattataaagatagtagtaatgatatttcccctcgaaaaaaataggcttttgagggtcgtttttccatttgtccggagtcgtaaaatgatacgccgcccggtaatccttcttatgctccgtgttgtttgtgtcagaggaattgtggtttttgttcggcagtaagccgacaaacaggaacgcacccaaaaagatcaatattacaacgggccattttcgtgccatgattgaattcaccatcttattgagaaataaaagaaaatgccaatgaagtatcggcattttctttttgttgttattagttgttaaccgtaagctgtccttgttcaaggatgctgtttttaacaacggatgttttcttgcctttgatgttcattaagaagcttggcgcaaatgtcgcctttttatcctcaaagaagcctctgtttgtcatgtagcttgtgatcacgacattgttgcctttggcttgcggcactgcgaagtgagagtaagtgaacgttacgtcgttaggatcaagacccatttgcaggacaagaccagttttgttcagcggcttgtaaggacctgttaaagagtttgatacataaccaagcatgtaaatatcgtttgagttaataccgtcgatcgtcatttttgaaccgcgtgaatcagtgaacaggtaccatttgccgttcattttgaaaacattcgcgcgctcgatttcatcagttaccgtgtttgaagtgatcagcggcttcatgacttttttcaatgtgtaatcatcgtttaactctaccataccgagggcgccgttcgctaattcagcatcgcgttttttagcgctttgctgaagcttctgactttctttacggaagaagtttgtgctgccgccgtagtacgctttgttaaataaagattcttcgccttggtatccgttttctgttcccgtgttggcttcgaatacaaggtatttatgtcctttgtcttcaacgtagtgagggtctctcagcgtatggttgtcgccggatgtatagttcccttcatcgataaactgctgaacgttttgatatgtttttccgtcgccgtcaaaaatcgttttatgatcttcaactccgttgatcttgagcgtgtcatcagattttgacacatttacctgcgccgttgtcaggctttgtttgccgtaatgtttaccggaaaagtcagtgtagaataaacggatttttccgtcagatgtaaaggttgcagaaccggaccattcttgtgtctgttctttcaggatttcatcgttggcgtcgaacttatcgctgtctttaaagacacggcccgcgtttttccagctgtcgatcgagttgtcgccgactttttgataaaacatgtagatggatgtgtcatcagcgtctttcgggcttccggcaagagcaaacacgacgtgatagccgttgtattcagctactgttccgtcagcgttttggagcggccagctgtcccacacatccagtcctttcgcggactcgatatttttaattgttgatgggtcgaattgaggcacttggtatttttcactttgctgctgtttagggatctgcagcatatcatggcgtgtgatatgagagacgccgtacgtttctttgtaaggtttttgggtattttctttcgcgaaggcttgagtcgctcccctgccagaagtgcagtcgtaaaagttagaactgtggctcgttttgcaaattttttgatgttcatgttcatgtctccttttgtatgtacctttttttgcgatctgccgattcgatcctcctgcattcatggatgacaggtttgttacagaaaaaaagacctaaaatatgtatggggtgacgccaaagaatacactttgcccttaacacattttaggtcttgcctgctttatcagtaacaatcctgcatgatttacttgtcgacatcattctattagactctgattctattgacaactggtctattttcctcttttggatgatagtaaaatgaaaaaaggccttttaatatatgggtaattgagcctaaggggtgctctggccctaggaaaaaacctctctaaaaaagagaggttattttttcttgatagataataaagcgatggtggttaaaatcagcaaagtacccagccattctgatattccgaagggaacatgcagccagataacagttaaaaaagctgccgacagcggctctgcacaggcgagcaggctggtttcagaggcactcagatatttcaggctttccaagtagcaataaaaagcgatgagcgttccgaaaatgatgataaacacaatcgcggcatatgcaggaaaggaccactcgccttcaaatgtccagggcgggcggatcaagctgagggcggctccgccgatcagcatgccccatcctacaacaatggcggatccccatttcttcagcagacgatgcggctgaagggtgtaaaacgccagtgcaaacgccgaactgattccccaaaagacggccagaccggatatggacaggcttccgacattcccgtgcgtgaccaaaatgaatgtgccggcaaccgccaataagacggcgagcagctcttttcctgaaggaattctctttgcgcgaatcgctaaaaagcatgtaatgatcgccggtcctaaatactgaagaacggtagctgttgccgcgttgccatgctcaattgccgcgaagtaggtgtattgaacacctaacattccgaaaatcccgaataaaagaaggggaattctgtcccgtctgtctttccaaacagcccatatccgtcctttttctttgcggtacgcgattccgagcagaagcgcccctgacaccagaaggcgcaccgaagtcagccattctgtattaaaatggcggtgctggaacagatactgggcaaccgttcccgagacccccataagatagctcctgtaagcacaagccaaatgcctgttgttcgtgaataagaaagagcagcgtgtttttccaggatagacacccccgattctgatgttgcgacagcaacttacaataattagaaaaatgaacgccttacatgtgatatattatatattgtatattaataggcgtcaaaataattttagagtaagcgcttacgaaacggccgtctgatgaacgagctgtaaaaaaaacaccccggctggttgccggggtgttttggttattctgcaatcgcgtctgttaaaacaggaacgacttgtttctttctggatacgacgccttttaaaagggccgtgttgttttctaacgtcacgttgaatgctttttccacttttgacgcttgatcaccgatggcaagcgcaagggaatcattttccagaatatccgtaatcacgagaaggaacaggtcaaggttcttctcggcaattacttttgaaagagccgcttctaattccggctgccgctttttgacatcttcaatatcaactgtgttgacttgggcgatttcgacttttttgctgccgagcgtgaactctttcgcatcaagagaaatcagttcttccacagtttttttgcttaagtcggcgcccgctttcagcatgtttaagccgtactcttccgcatctacgccggcaatttcagcaagctcttttgccgctgcgatatcttgctccgtgcaagtcggagatttaaataacagagagtcggaaatgattgctgacagcatgaggcccgcaatttctttctcgattttcacgttattttctttgtacattttgtttaagatcgtagccgtacagccgaccggctcagcacggtagtaaagaggttccgctgtttcgaagttggcgatacggtggtggtcgatcacttcaagaacctgaacgtcttcgatatctttgatgctttgctggcgttcattgtggtcaacaaggatgacgccgtttacttcgtttgcggctgtttccaccaaacgcgggctttcctgcttgaaataatcaagcgcgtattgtgtttcgccgttgacttgtccaaggcggacgggctcagcattgaagccgagtttattttttagatcagcgtaggcaatggcagagcaaatggtatctgtgtctgggttttgatgtccgaaaataagaattttttccataataactccttgtccttttttgtagtgtaaacaatctttttatagtttaacacgtcttgcggagggtgtaatcttcaaaaccttaaaaattgatgtgaaaaagaagcatttttgttgagcggtgaggaggattgcgagtaaaatactgggtaagtcagatgctaatcagcatatagtatcaaaaaaggtactatggaggatgaaaaatgaacatatatccgaataaagaaggttgtccggttgaactgacgctttccgttatcggcggaaagtggaagggtattttgttttatcatatgatcggcggaaaaaagcggtttaatgagtttcggcgcatttgccccagcattacgcagcgtatgctgacgcttcagcttcgcgagcttgaggcggacggcatcgtgcatcgcgaggtatatcagcaggtgcctccaaaggtggagtattctcttaccgaattcggcaggtcgctggaaccgatcgttttgcaaatgaagaaatggggagatgccaaccgggagtttctcgagacataccgggaaaaaacgtcgcctcaagatcagtccgctcaaaaataagaagcagcaaaggattaaattccttgctgcttttttttatttcatcgcgatggcttttctggcgttgcgcacatcattcttcagcaattcgctcaggttgtaagccggatattgaccgcgttcttccatatactcaaagaccatttgatgccacttgatggccgcgtttaagtgcttgacgaaaacgtgtctcaattggggtgtggccgtctctgtaatggctccggcgtaattgcgcacagacgttttggccatgctcagcagaccgccgctgtaaaacgcggaatcagcgcgctcttctgtttcatcctcacgaaaagcgggagcttcagggaagaaaggaagcagttcacgcagattttgttccagcgaatggatggaaaatcggtaaagctgttttaatctggcatcgcttacgtcccgctctgttctttttaatttcacaagtccgtttgcctggaaagccactaactcatgcagttctaacgtttcatgccatgctaatgttctccgctcggtcatagtgtaagaatctcctttatccttcattttcactttcagcatatgccccggtcccgatgttgttcctgatgttttgaagtttccagaaagggaaactcaatgtaaaggaaatacgaaatagaggtgaaactatatgtgggacatgataaagaacttcttccttttcagcagcggggttttacaggcgaccactctcttacttatcgttatcgtcttgttatatgtacgaaaaaccaaaaagaaaaacagagaaacttctggttttatggatgatcaggatcactgatacaacgggcattctttcacggggatgtccgtttgtctgttttcatgtttcacatggaacattgcggctgtccgcgctcattttacttgcgatttcgacttatgttaaaatatatacgtgtattttggagagtttatggaaaattcaggtcttgaaagagacattgcggcgtcaaaagagcagtcgtctaagctgctcttttctattcgtatgttcgaatgatacaaggtttgaggtgagtaagtgaaaaatacaagggctctaatagaaggcgccattttgatcagtatttttgcaatcatttcccttttggtcgtgtacctccctttactgggggcaattcttctctttgctttgccgctgccgatcattctttacaccattcggcacggtctgaagcccggggtatggatggggcttgccagccttcctgtcagctttattgtaggttcgtttaccgggcttacaggcgcttttacggcggcctgtacgggaatcgccatgggatattattttaaaaagaaacagcccggctatgcggttgctgccggcgctatggcgtatgtgctgtgcggcgtcgttttttttgtggtcagcatcgtgtttcttaatatgaatgtgatcgataccaccatgtcccagcttcgggagtcgatgtctttagcagaaaccatgtcaaagcagctcggttacggagatcagttcgggaagcagatcaagctgatggaaagtcagctgagcacggttcaatatctttttccgacagtgctcgtattgaccggcatcgttttttctttcctcagttatgctatggcaaggccgcttttacggcgattttcccctgatcttccgaagatgaagccttttagagagctcaaactcccgcaaagcgttgtcattctgtattttattgtgacgatattagggtttctgcctttagaaaaagggcatatgctgtattcggtttcattgaatgggggatttattctcagcttgctgatttgtattcaagggttagcgtttatttttttctattgccgcgaaatggagatgccgaaagccgttcctgttttagcaattgtgctgggtgtgctttttccgctcatcttgtccgtgtatctcctcttaggcatcattgacataggctttaacataagaaataaggtgacgcgaaattgagtgtgacttacaggtggggagttgatagaaatgcctagtttttatgaaaaaccgttgtttcggtatcccatctatgcattgattgcattgtcaatcatcataatcctcatcagcatttactttaactggctgataggagccatcggcgttgtgctgctcgccgtgatcctgtttttcattaagcgtgcggattctctgatcagaaaagaaattgacgattatatctccacgttatcgtatagattgaaaaaagtaggcgaagaggcattaatggaaatgcctatcgggattatgctgtttaatgatcaatattacattgagtgggcgaatccgtttttgtcttcctgttttaatgaaagtacgctcgtcgggcgctcgctgtatgacacatgcgaggccgtcgtgccgctgatcaagcaggaggtcgattcggaaacgatcaccttgaatgagcggaagtttaaagtagtgattaaaagagatgagcggctgctctatttctttgatgtgacagaacagattcagattgaaaagcagtatgaaaatgagagaaccgtgctggcatatatctttttagataactatgatgacgtcacacaggggctggatgaccaaacgagaagcacgatgaacagccaggtcacctcattattaaatgcgtgggcgcaggagtacggcattttcctgaaacggacgtcctcggagcggtttatcgcggtgttaaatgaacacattttaacggagcttgaaaacgcgaaattttcgattttggatgaaatccgtgaaaaaacatccgttcacactgtatctttgaccctcagcatcgggatcggcgcatcggtttcttccttgaaggagcttggagatctggcgcagtccagcctcgatttggctctcggccgcggaggcgaccaagtggccatcaaaatgccgaacggcaaggtgaaattttacggcggcaaaacaaatccgatggagaaacgcacaagggtgcgcgcccgggtgatttctcacgcgctcaaggagattgtctcagaaagcagcaatgtcattatcatggggcacaaatttcctgatatggacgcagtcggagccgcaatcggaatattgaaggtggcgcaggccaacggcaaagaaggctacatcgtcattgatccgaaccagatcggatcaagcgttcagcgcctgattgaagaaattaaaaaatatgaagagctgtggtcgcggttcatcacaccggaagaggcgatggagatttcaaatgacgacacgctgcttgtcgtcgttgatacacataaaccgtcccttgtgatggaagagcgtctcatgaacaaaatcgagcacatcgttgtgattgaccaccaccgcagaggcgaggaatttattaaagacccgctgctcgtttatatggagccatacgcttcatccaccgcagaactcgtgacggagctgcttgaataccagccgaagcggctcaaaatcaatatgattgaagcgacggccctgttagctggtataatagtggatacgaagagtttttcccttcgcacgggctcgcggacgttcgacgccgcttcttatttgagagcgaaaggcgcagatacggttctggtgcagaaagttctcaaagaatccgtcggttcttatatcaagcgggcgaaactgatccagcatacagctctttataaagaacatatcgcgattgcttctcttcctgagaacgaagaggagtactttgaccaggtgctgattgcgcaggcggctgattccctcttatcgatgagtgaagtggaagcttcatttgcggtagccagacgggatgagcatacggtgtgcatcagtgcgagatcgctgggcgaggtcaatgtgcagattattatggaggcgctggatggcggagggcatttaaccaatgcggcaacccagttatcgggcatttctgtctcagaagcgctcgtccggctgaaggaagccattgatgaatattttgagggaggcgttcagagatgaaggttattttcttacaagatgtaaaaggtaaaggaaaaaaaggcgaaatgaaaaacgtagcagacggttatgcacataactttctcattaaaaaaggcctcgctgtcgaagcaaatgcgacaaacatcagcgcattgaaaggacagaaagaaaaagagaaaaaagaagcgattgccgagcttgaaagagcgaaagatttgaaagaaacgcttgaacagctgactgttgagctgagtgccaaatccggtgaaggcggccgccttttcgggtctgtcacaagcaagcagattgcagaagcgctgcaaaaaacgcataagattaaagtggataaacggaaactggagctccaagacggtatccgcacactgggatatacaaacgttcctgtaaagctgcaccctgaagttcaggctgtgctgaaggttcacgtaaaagaagaagcgtaatacacaatgaaaaacccgccgatccggcgggtttttttcatgtcagcagacggcgcagcgcaagaaaatgatgagattgtttcatttccgatcgttaccagattgcatattatattacatcataacgaaggatgtgtcggtatgaaacgatttttttctgaaacatattttaataatccggagaataaaaaggcgctggagcattatccgctgatcggagacggaaaagacggggaagtctaccgcttaacacacaacaaatgcataaaatacttctttgaaaaagggacatgcaagaaggaattggcggctttaaagaccggacaaggttccccggtgattccaagactgtatgaatacggagatcgttatattgtgatggaatacgtccaaggcacctctcttgcccgccatatcagaaaagaaaaatccctgtccgtcaaaatgactgctgatattttaaatatgctggatgaattaaaaagaatcggttttaccagatgggatgccgaaatcaggcacattctgatcaatgaacacggaaatcttaaagtcatcgaccataaaagagctttttccgctattacccggtttcccgtaaaactattaaaaggactggacaaatacggcttggcggatgagtttttgaatactataaaaaaattaaatccgtcacgttacctggaatggcagccgcacatgtaagtttctgaaaatccgcacatgtaagtttcctttttttagggtcgtcatatgatatttgtaacatttgtttggtggagtgtggaaaaaatggcagaatacattatggttatcggcgctcatcccgatgatgaactattgggagcagcgggcaccataaaacggctgatcaatgaaggatataaagtgatttccattattacggcattaggaagaaaagaagaagctcatcatattaaacaattaggcgaacgcgcgaatcaagagcttggaattgagaaagtcatctttttggagcatacgaatttagagctggaatgtatccctcttcataagcttgtcaaagaattagagcagctcattcgcgtctatcagcctgataaaatctttacacatcattacggcgatatcaatatggaccaccagagaacattccaagcagttttaacagccgccagaccgcttccgaatcaaaaacctatcgaactgcttacgttcgaaacgctatcttcaagcgagtgggagaggaatacggctgataaactcttcaaacctaattacttcgttaacatcacagacacaatggatgctaaactcgcggcgcttcaccactatgacgtagaaatgagggattaccctcatccccgttcatatgaaggcgttaaacatttaggaaaagtcagagggatgacggcgggtgtggaatacgccgaagcttttgaagtcgtgcggaggatctggaaatgatcaagacattttccgtcccgtatccgtatatggtccagacgcttgaccgctactacggggtcaaaacgcgccctcaaaaaaaggcggcagtaaagacacagttgaaacatgaacatcatattccgcggttatacaggaaaaaaaagaagttatccattttgattgccacgttttgggactacccgcacacgggcggtttatcaaactatattaaaacgcttagtgaaggcctgaagaagaggggtcataaggtggatgtcatctcccctaatctgtttccgtccgcacaggtaaaagaactgcgggcggctgttgttccgaagttaaaagatttctttaaggacagatatggggattataacaatcatattttgaaaaataatcggctgatgtttatatacgagcaaatgcttcaaaagattcatttggaaagatatgatgtgtttcatgctcaagatttatttacagccaatatattaggcagattcaatcaaatctataagaaacctttatttttcacaccgcatggcatgtttactttcaacagacttaaatttcacatctttaaaaaaggatcgatagaagagttttattataaaaaactagagatgaaagccattgaatacgcagatcgcctgattattatcagcgatacgttccgcagcccgctcatgaagctcggagccgaacaggaagacatgacaacggtgatcacaggaatcgattacgatgcaaaaacaggcgggaaaagaaaaatcccgctgccgaaaaataagatcatcatctcgtgtattgcaagattaggcccgagaaaaggacataatcatttgcttgacgcactttcacgaattccgtctgatgtacttgagcatgttgaagtgctgatcgcgggcgacggagagatgaggagcgccttagaggaacaggctcgaaaactgaatctatctatggtttcctttttaggaaaaagagatgatgttcccgctattttgaatatgacggacatattcgtactgccgaccgttaatgacagtctgcctatttcgattattgaagcgatgttcagcggctcggctatcatcgcgaccgattgcgggggtattccggatctgatccgccataacaaaacggggcttattgtcgagccgggaaatgcaaaggttcttgcccgggctttagcgttttttatcactaacaaatctgcgcggaagatagctgcttcaaacgcaaaggcctacgcggagaaatatttgagcagtgagacgatgataaaaaatatcgaatcgatttatcaaaataccaacagctcggagggagatcatgaaacatgaacatgcagccgttgtactagatttcagtgcaaacgggattgggatcattcgcagcctggcccgaagaggaatcgatgtttacgcatttgacacggagggaccttatcgtatcggaaaatcaagattggcagattgcgggatatgtcccagccctttaacacaagaggaagaactgctgacattcctgactgatttcgggaagcgattccaagcaaagccggttctgtatgcaggttctgatgattatgcgggatttatatctaaattccgcgagacattagccggtttttttttatttttgctcccgagccgctctctgttagaaacggtcttagataaaagcaaagcatatgaattagcggtcaagcataacatcccctgcccgaaaaccttttttccgaacaaccgggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcttattctctctgcaaaagaaccatcaattccctgctgattttggcgcgggggcccacgtcgtcagcaaacggcttcctgatttaatcgagaagaccctgccgttttttgaagcgattcagctgaagggagtaggcatggcagaatttaaaaaggacccccgggacaatgtttataagtttatcgaaattaatccgcgcttttggctcagccatagcctgacagaaccggcaggcattcatttcgtttacatgtactatctgtatttgaccggacaacatgtgaagccccagctcgaacaaaaagacggaatcaactggatttatgaggtgcgttacttcttaacgtttttgaagaaacgaaaaagaggagaaatgacgttccgggatttttggaaaggatttaaaggaaaaaaagagtacgctctgtttgcttggaatgacccgatgccatttatcagaaacacttggtctcatctcaaaaacagctggaaacggaagcggaaggaagatcggcatgtatgaaaaggatcttttgtatgacgcatttcaaaaactgagaattgacgaaaaactgtcgtattcgttcggtgaaagggccgcggtgaatccggatgacatcacatgcctgaaatcaacagacagaagcgccatttataaactgtttgtaaagaaaaaatccggaattgttccgctgatattgaaggtgtataaatcttcacgtgaaaaaaacaaggtcgagattaatatatacgggaaagcccgttctgttttaggggatttgctgccggacatctatcttatagaggaaagtgaccatgaaacgtggatatttatggagtttgtcagccagatcagaggacagcttacatttcatccgaagcatttcaagtatattattccgtctgtcgcagaactgcacagccgcacctttgaaaacaaggctgtttctgacggtaaatggcggtcgtggctgccgctatacgaatcggaaaccatgagaaaagggcgtaaaaagcagatcaaaaagacagcggaattattggatagagctcttaaagatgagcgcacaaaggatatcgtgaagcctcattatcggcaaatcacaaacttgctggagcaggaggagccgggttttttccctgaattggtccaaaacggctcagccatcacacacggtgatcttcatatgcagaatatctgcacccacgatgcgtccggacatgaaccgtgggatattcaattcatcgattgggaatccgcaaagtacgcgccggtttggtttgatatgacggtgctggtcgaaattctgctcggcttcagaaaagactggagccggcacgcagaagatattcggacgtattgcgtaaaagtgtatacgaaagaaatgaaaaagcggggcattcattttcagacccctcctatgacgctttataaaatggcttatttgcagagaacacttgagaaagggcttcatacccaattgcggagaatcttcgacaatcggggaggagaactgctgccgtatcatgttgacaaagtgtcaaaatggggacgggaattaggattataagtttaagagagggggagcggatttgaaaggagagatcggcaagccgaacggtctggtgcctctaaccttattgcgcgtcatggatcaattttacgggatcgaacatcaaagtgagccggagatgctgtattcgttctgtgcggaaggaaaaagctcccccaaacgaaaaaagccattgcgtattctgtacgcaacctttctccgttacccgaatgtcggaggactggcgagttatatcacgtcaattaagacgggttttgagcgcatcggtcaccaggcggatgtcatctcgccgctccaaatgccgccaactttttttcaggaagatatcccgcgggccgctgacgagatcagagcgtttcttgttggcagatacggggccgcaaacgaaaagtttgtgaagaatctcagctatttacatgtctttcaaagatttttgaaggagaaggacttagaacaatatgacctgtttcacgcgcaggatttatttgcggcatttttgctgggataccttaatcaaacgtatcggcatccgcttttttttacgccgcacggacatttcacgaaaagccggatgaagtttcataaaatccaaaagggttcaatagaagaggcatatttcagtgaaatagaaaggcagggtattcgggcttcggataaaatcattacaatcagcgactcctttcacgagcccttgctggagtacggagcgaaggaggctcagctgacgactgttcataccggcattgacatccgggttgcacccgagccaaaacgtgctgaaaaggtcgtgattgcgtgcgtttcccgtctgaccgagcgaaaaggacatgatgtgctgctggacgctctcgcccgcatccggcaccatttatccggagtggatatatggatcatcggggacggaaacatgagagggtttctggaagagaagagacggaaactgggcctctcaaacgtgtttttcctcggaaaacgacatgatgtgccggcgcttttggctgaatcatctatatttgtcctgccgacattgaatgataatttccccatagcgatcatcgaagcgatgttctcaggtcaagccattgtcgcaactgactgcggaggaatccctgagatgatccggcacgaggacacagggcttatctgtcagcccggcaacagccgcgaacttgctgatgccctcgtaaagctgattacggatcagtctctcagggaacggcttggaaaagaagcgcgctcctatgccggccggcatctgcgtcaggaactgatggtttcaaaaatagaaaggatttatcaatcatttttctgaatgataccggcgccgcatggcaggtgcttcaagagcaaaataaagaggccggtgtttaactatccagcctctttccgagctgttttttcatctcatacagagtctgctgactttgtccgcccgggccgcctgtcattcctcatcgggctgagcctgtttttccggtgctgtatcggtcagctgagatttttgtgccgttctttttaatccatgagacaagctttgtgttgcctgaattgtttccggataataagaaatagttcacttttccttcgtcaacaagttttttcagctgtgagacggttttaccgaaattttcttcatggaaaaaagaggcggaaagccatcgcttccgcctcccgcacatatatatgagagagcagcctttatttgtgatcgttctctttttggatttcagctaatttggcaagcagaatgtgctgaggcatgtgcatgattctctcaagcggcatattcagtgattctgcgagcttttgcgccgtttcggcggaaatttgcagcggtttcatgtgatcactccttccgtttctttattgtactaaaatcagaaatctatcgtaagaggatatgacaaaggaatggaggtttgaaaagcggggctttataacagaatgggggaggttttttatgcaatcgccattgatgttattacagctgaagctggctgattatcagaaaaaagccgcagaactgcggacaattgacgaatttatcatactgaaacagacattgcaggacatgatgaaagtattcgccgcctttgaagaatgggagctgtatcaaaaaacggccgatctcatggcgcagacggtgctgcacatccgtttcatcgaataagaaaagccctcgcacgggcgaaggcttttcttaaaaggaacgttcctcttcaatgtttttatgctgatcataaatgacaagcttagccgggctgttctctttcgccatctgctccgctttttcaatcgccgcgtcctttgatgtacaaagagccgtcggcgccacattttccaccttcacaaaccatccgtccgcatcaacactgggtgttactgcatatgttttcatccttcttacctcccggtttcgatttatttatttgtttcccggcattcggaacggtaaaacacataaccctctcctgacaaatacagggaaagtgatatttttctattctttttcatgagaaatggtaaaatgaaatttggatattttttaaggaaaggacggtgcttagcatgacagaccttctgaatgatcggctgccgccgcaaaacatagaagctgagcaggccgtgttaggtgctgtttttttacagccgtctgcgttgacactggcttctgaagtgttgattccggatgatttctacagaatgtcacatcaaaaaatttacaatgccatgctcgtgctcggagaccgcggtgaaccggttgatttggtcacggtaacgtcagagcttgcgaataccgatttgttagaagaggtgggaggcgtctcttacctgacggacatcgcgaattccgttccgacagcggctaatatagaatattacgcgaaaatcgttgaggaaaaatccattctccgccgtttaatcagaacggcgacctcgatcgctcaagacgggtatacgcgcgaggatgaagttgaagatttattaagcgatgcggaaaaaacgattatggaggtcgcgcagcgaaaaaattcgggcgccttccaaaatattaaagacgtgcttgttcaaacatatgacaacattgagcagcttcacaaccggaaaggcgatattaccgggattccgaccggctttatcgagcttgaccggatgacggcgggttttcagcggaatgatttgatcattgtcgcagcccgtccgtctgtggggaaaacggcgtttgccttaaatattgcgcaaaacgtggccaccaaaacggatgagagcgtggcgatattcagtcttgagatgggtgccgagcagcttgtcatgcgtatgctctgcgccgaagggaatattaacgcccaaaatctcagaacgggtaatctgacggaagaagattggggcaagctgacgatggcgatgggaagcctgtcaaacagcggtatctttatagatgacacccccggcatccgcgtcagcgaaatccgttcaaaatgccgccggctgaagcaggagaacggattgggcatgattttaattgactacctgcagctcattcagggaagcggccgttcgagcgacaaccgtcagcaagaggtatcggaaatttcacgggcgctaaaagcgctggcgcgggagctcgaagtcccggtcatcgccctgtctcagctctcccggggtgttgagcagcggcaggataaacgtccgatgatgtcagatatccgtgagtcgggaagtattgagcaggatgccgacatcgtcgccttcctgtatcgtgatgattactatgataaagaatccgaaaacaaaaacatcatcgaaatcattatcgccaaacagcgtaacggcccggtgggcaccgtctcactggcttttgtgaaagaatacaataagttcgtaaatctggaaaggcgctttgatgacggcggtgttccggcaggtgcgtaaagcctcaagcaatgtcttgaggctttttttcatccgaaagaatgagagaatgccgtctgttcggcagtcgataaaaagaaagcgcttttatataatggcattaagggagggatgatgatgacaattgaatttccgcaatttcaagcggcgcaaatccggattgcccggccgaccggacagctcaaagaaatcatcaggttttatgaagaaggcctcggattgaagagggtcggcagtttttccggacatgagggctacagcggcgtcatgttcggcctgccgcatacgcaatatcacttagaattcaccgaagaaaccggctcgtctcagccggcgcccgttccgcacggcgacagcctgcttgtcttttacatccctgatcagcaggaggtcattcgcatcagcacgaaattaaagcagatgggatatgaggagaaagaacccgaaaacccgtactgggaagaaaaaggcgtgaccatcgaagatcctgacggctggcggatcgtcctgatgaatacaagcggaatataaatgactgtctgaagaacccgggatatgggttctttttcgtgttaaagtatgaaagtttcgggagtaatagatagcaaatgaaagagaaaacgcttttaatcaggtttaaggcgaacaaatatagaataataagattttaatgttcggatttacgattgactttctgtttcggcactgatacacttaatttgtttgaatgagatatcgttttgaaaggttaacggaggtgcacggatatatgtcttcagtagtcgtagtaggtacgcagtggggcgatgaaggaaaaggtaaaattacagatttcctatcagaaaatgcagaagtgatcgcacgttatcaaggcggaaacaatgcaggacataccatcaagtttgatggcgtcacgtacaagcttcatttaatcccatcaggaattttttataaagaaaaagcgtgtgtcatcgggaacggaatggttgttgatccgaaagcgctcgtaacggagcttgcgtatcttcatgaacgcaatgtgagcacggataacttgagaatcagcaacagagcccacgtcattcttccataccatctgaaactggatgaagtagaggaagaacgcaaaggggccaacaagatcggcacaacgaaaaaaggcatcggacctgcttatatggacaaagcggcgcggatcggcatccggatcgcagacctgctagatcgtgacgtgtttgcagaaaagcttgaacggaaccttgaagagaaaaaccgtctgctggaaaaaatgtatgaaacggaaggcttcaaaattgaagatattctggatgagtattatgaatacggccagcagattaaaaagtatgtatgcgatacatccgtcgttctgaatgacgcgctggatgaaggccgccgcgttttatttgaaggcgctcaaggggttatgcttgatattgaccaagggacatacccgtttgtcacttcatccaacccggtcgccggaggggtgacgatcggttcaggcgtaggtccgacaaaaatccagcacgtcgtcggtgtatctaaagcgtacacaacccgtgtcggtgacggtcctttcccgactgagctgaaagatgaaatcggggatcaaatccgtgaagtcggacgcgaatacggcacaacaacaggccgtccgcgccgtgtcggctggtttgacagcgttgttgtccgccatgcccgccgtgtcagcggaatcacagatctttctctgaactcaatcgatgtgctgactggcattgaaacattgaaaatctgtgtcgcttaccgctacaaaggtgaagtgattgaagaattcccggcaagtctgaaagctctcgcagagtgtgaaccggtatatgaagaaatgcctggctggacggaagatatcacaggcgcaaaaacattaagcgatcttcctgaaaatgcgcgccattatctggaacgcgtatctcagctgacaggtattccgctttctattttctctgtcggtcctgaccgttcacaaacgaacgtcatccgcagtgtataccgcgctaactaagaatttgcagcaaacaagcctccggtcacggaggcttgtttttttatgtaggaaaaaaataatagattttttttcaaaaaagtagttgccactttcgaatgttctatgatattataaatctcgttgttacggaacagcttcaatagagtactgcaagaaagcttttgtctcaatgctctatgatacataatccgacacatcaagagccattagctcagttggtagagcatctgacttttaatcagagggtcgaaggttcgagtccttcatggctcaccactttttatggcccgttggtcaagcggttaagacaccgccctttcacggcggtaacacgggttcgaatcccgtacgggtcattgatttactttagcgttattgctaactccttatttgtcctcggagggccgccacgatacggttctccggacaaattactgtaaggtccggtagttcagttggttagaatgcctgcctgtcacgcaggaggtcgcgggttcgagtcccgtccggaccgccattttactttactttatagtatagaaaagaaacatctggctcggtagctcagttggtagagcaacggactgaaaatccgtgtgtcggcggttcgattccgtcccgagccacttacccaaacgcatctgcaatagtaggtgcgttttttcttttgttataaaaaagggagagccggcttttcagccggcccagaagaagacgtcaaacactagacggcgttttttttcttaaggtttcaaaaaaatattattttttaaaagaaaataaaaaacatgacaaaaggatggcagttcaatacgtttttgcgctgttctctttaatttttttatcttttgacctgaaaccgttataatagacggggaacgtttttcacgatacgaattgtgatcatcatgaaacatcaatagatgaaatgaagtcattctggcaggaggaaaatcaagatgatggataagaaaatccttgtagtcgatgatgaaaaaccgattgcagatatattagagtttaatttaagaaaagaaggctatgacgtgcattgtgcgtacgatggaaacgaagccgtggaaatggtggaggagcttcagcctgatttaattcttttagatattatgcttccgaataaagacggagttgaagtgtgccgggaagtccggaaaaaatatgatatgccgattattatgctgacggcaaaagactcggagattgacaaggtcatcgggcttgaaatcggagcggatgactatgtcacgaagcctttcagcacgcgtgagcttctggcccgcgtcaaagcgaacctgcgccgccagcttacggttgcgccggctgaggaagaatcagcttctaatgacattcatatcggttctctcgtcattttccctgacgcttatgtcgtatcaaaaagagaagaaacgatcgagctgactcatcgtgagtttgaattgcttcattacttagccaaacatatcggacaggtcatgacccgtgagcatctgttgcagactgtgtggggctatgactatttcggtgacgtgagaacggtggatgtaacagtgcgccgtctccgtgagaaaatcgaggataatccgagccatccgaactggatcgtcacaagacggggtgtcggttattacttgagaaatcctgaacaggactaaccggcgatgaataaggttggtttttttcggtcgattcagtttaagatcacgctgatctatgtgcttctcattatcatcgccatgcagattatcggcgtgtactttgtgaaacaggtggagaattctcttctcaagtcctatgaattatcgttaaatcagcggattgacaatctatcctattatattgagcaggaatataaaggagataatgacagcaccgtcattaaagatgacgtcaaacggattttgaatgattttacgaaaaacaatgaaatacgggagattacatttgttgataaaagctatgaggtcgtcggttcttcgaggccttatggcgaggaaatagcggggaaacagacgactgacccgatttttaaacggattttctcaacaaaacaggcctattcaaaaaaatattatgatcctaaaagcaaaaacagagtgctgatttcagcaaaacctgtcgtcacagagaatcaggaagttgtcggcgcgatttatgtcgtggccagtatggaagatacctttaaccagatgaaaaccgtcaactcgattcttgcttcaggaacaggcttagcccttgttctgacggctcttctcggtatatttctcgcccgcaccatcacccatccgctatcggatatgcgtaagcaggcgatggaactggcaaaagggaatttctccagaaaggtgcggaaatacgggcatgatgaaatcggtcagctcgcaacgacattcaaccatctgacgagagagcttgaagatgcccaagccatgacggaaggggagagaagaaagctttcttccgttatcgcgtatatgacggacggtgtcatcgctacgaatcgcaacggggctattattcttttaaacagccctgcgcttgagctgctgaatgtttcacgtgaaacggctttagagatgccgattacgtctttattgggcataaaagagaactttacatttgaggatttagtagaacagcaggattcaatgctgctggagatcgaacgtgacgatgaaacgactgtactgcgggtgaatttttccgttattcagagagagcacggaaaaatcgacggtttaatcgcggttctttatgatgtcaccgaacaggaaaaactcgatcgggaacgcagagagttcgttgccaacgtgtctcatgagctgcggacaccgctgacgaccatgcgaagctatttagaggcgcttgcagagggcgcgtgggaaaacaaagatatcgctccgcgtttcttaatggtgacccaaaatgagactgagcgcatgatcagattggtgaacgacctgcttcagctttctaaattcgacagcaaagattatcagtttaatcgggagtggattcatatgatccgctttatgtcactgattatcgatcgttttgaaatgacgaaagaacagcatgttgaatttatccgcgagcttccggacagaaatctgtacgtggagattgatcaggataaagtgacgcaggttctcgataatatcatttctaacgcactgaaatactcaccggaaggcgggcatgtcactttctcagtcgatgtgaacgagaaagaagagctgctttatatcagcgtaaaagatgaaggtatcggcattccgaaaaaagatgtggaaaaagtctttgaccgtttctacagagtggataaagcgcgcacgagaaaactcggcggcaccgggctcggccttgcgattgcaaaagagatggttcaggcgcacggcggagacatttgggccgacagtgtagaaggcaaaggaacgaagattacatttactcttccatataaagaagagcaagaggatgattgggatgaggcgtgaaaatataaaaacagtcatactgtcagtgctggtcgtcattagtcttgttttaacatggggaatttggacattccagcccaatttttcagaaggcacggcctcaaccaaatcgactgtccgggaaaagcataaaattgataaaacgagccaaaaagtgtcgcaaacggtaaaaccccgggatatgtttattcatacaaacggctctcattataaagtggatgatgagacgctctttaatgacctgtgggcggatttgccgcaatgggaagtaaaagggatgaaggatatttccgatcaatacgacaagctcggttttaaaaattggctttacggcagaaacggcaattcggcaaagctcgatctgcaattcaatgacaccattccgattgatttcttccaatcgatgtttaaatggtcaaatccgtcaatggaatacagctcatttgaccatattgttattccgtttaatgagaataagacgaataagaagatttacatggtctcgtacagcaagcagctgattttggaagtgactgtggaatcggcgaattaccgcaatctgatgaatgagctgtacagcaaaaagtcgagtatgccgttataccacctctattcggtcggaaaaagcaaagaatttctcatgccgaatgcgcggtttaatatgaaggaaaaagaatttatcactgaaaccattaagacgaacctgtttaagcagacgctttttaatgatccgagcacggtcagagaggacccgaattacaatcggaatgtgctgactgacggaatcagccgtctggaaatcaattcgacacagcggcagattcaattccagcatcggaatttggcacaaagcgcttcttaccaaacgggtgagctgattaagaaaagctataaatatttagaggatacgggaagctggacggatcattatcaatttttcaatgtgagtgataaccagcagctgagtttctacatgtttaaagaccaaatgcctgtgatcaacagcacgtctaagcctttcggatccggacctgttttgaccctgcaatgggccaatgacgaggttctcagctacaagcggccgaactatgttctcgggccgaatccgattaaaacaaaagacgtaaaaatgatgaacggcaatgaggttgtgtctctgctggagcagcaggataaatacgacgtgaacaaaatcgaccagatcttcctgtcctatcaaatggtctcttcttcaacgaatgatctcgttgaactggaacccgtctggagtatgaagatcaacgggaagatcgtcccgattacgaaagatctgctggggaaggaggaggacgataatggagtggaataagacaaaaacgatcttcatcattgccttcctcatcctcgatatttttctcggctatcagttttttgaaaaacgctcgagcagtgaatacgaagtgattaaaaattcaaacgtggaaaaagacatggagatggaccatatcacattcggcaacctgtcttctgattccgcgacgggctaccggctgacggcgggccaaaaggtatttaccgctgaagatattgatgctttgaaggatcaaaagccgttaatggaaatgccggcggatgatcataaggtcacaacgctgaaaatgaaatttaccgatccggtcggtttatcgaagcaaaaaccgcaggaggatgcggaatcgctcgtcagttctaaagtaaccggcggtgaaaaatataaactgtggaaagtcgacaaggatcaaaaacagatcattttttaccagacatatgacggacagtttatttatcaggattttgactcgtccacggatgcgatcggacaggtgattctgcatctgaacgataaaaaccaggtcgtatcctacgagcagaccatgctggagtcattcaagcgaatccagaccgagagcctgattcctgagcttgatgcggtcgaattattgtattctcaaaattacttaaaagcgaattgcgccgttaaaagcgtcaagttcggctatattgcccaatacccgctgacaagtacgcaggtgctggcgccggtatggagaattacaattgaagataagtcaaaagggacgaagaaaaagacacagcaaacgtacactgtgaatgcattggaaagcacagtcattgataacaatcaaaataaataatggagtgagacacaatgggcttgcaatttagcgtgcttgcgagcgggagtaccggaaacgcgttttatctggagacagaggagcattcttttctggtggatgccggcctgagcggtaaagcgatggacgggctgatggagagaatcggccgcaagatagacgacgtcgacggcatctttgtcactcacgagcacagcgaccatattaaagggctcggcgtaattgcgagaaagtacggtctacccgtctacgccaatgaaaagacgtggaaagcgatggagaatcagatcggcaagcttgataccggacaaaagtttttgttcccgatggaaagcgtaaagtctttcggcgggcttgatgttgagtcattcggcgtctctcatgacgcggccgagccgatgttttatgttttccactaccaaggcagaaagctcgcgctgatgacggacaccggatatgtgagcgacagaatgaaaggcatcatccgttcggccaatgtgtttgtgtttgaaagcaaccatgacgtcggcatgctgcaaatgggcagatacccttggagcattaagcggcggattttaagcgatgtcggccacgtctcgaatgaagatgcggcgctcgccatgactgatgtcatcggcgacggcacatcgcgcatctatttggcgcatctgagccaagacaacaatatgaaggaactggcgagaatgtccgtgcagcagacattggctgcgaaaggatttgtcgccggggaaacgtttcagttatttgataccgatccgaaaattccgacgccgctgtgcgccgtgtaatttttccaaatgaatcatgattattaatccgcgatctgacccacactataagcaaatcgagtactcttgaaaggatttgagatagggtggattataatcgcgatgatgaacagtacgcctccgaacagccccgccgcagcaagagaggatactttctatcaagtctgatcggcgtcatcgtcggggccgcgctcatggctttcctgatgccgtactggacaggcggagaccatggagacagcagcaaaagcaccagccggcgtctcggcagcgaacaggtgaaaacagtcaacgtaaatgtcaatgacgctgtcacgaatatggtcagccgtgtatcggattcggtagtcggcgttctcaatatccaaaagactgatatttggggagagggcggcgaagcgggaagcgggtcgggcgtcatttacaaaaagaacggaaacacttcttatatcgtaaccaatcaccatgtcattgaaggtgcgactgagattgagatcagcctgaaggatggttcgcgcgtgcctgctgagctgatcgggagcgaccgtctgatggatctcgcggtactgaaggtgaagtctgataaaatcaaatcggccgcccagttcggcaattctgatcaagtcaaagtcggagaaccggtcattgcgatcggaaatccgctcggacttgaatttgcgggatcagtgacacaggggatcatttcaggcacggaaagagcggtgcccgttgactcaaacggcgacggacatccggattggaatgcggaagtgctgcagaccgacgccgcgattaatcccggcaacagcggcggcgctttgatggatatttcgggcaaggtggtcggcatcaactcaatgaagatcgctgaatccgccgttgaaggaatcggcctgtccatcccgtcaaagcttgtcattcccgttattcaggatttagaaaaatacggagaagtccgacggcctttcctcggtattgagatgaaatccttaacggatattgcgagctaccattggagccagacgctgaaacttccgaaaggcgttaaaaccggggcggtcattatgggtgtcgacgcgttttcaccggccggaaaagcgggtttgaaaaagctcgacgtgattaccgggttcgacggacataaggtcaatgacgttgtggatctccgtgagcgcctgtatcgcaaaaagatcggcgaccgtgtgaacatcacgttctaccgttcgggaaagaaaaaaacagcggaagtcaaactgacagaagcagatcgattacagaaataaaaaagcagcccggacatccgggctgttttttattgatttatttgttaatattatactattgtgaagcagggaggtgaaacacatgaaaacggctgatgtgatcatcgtattgaatgaaatcgagggtgaatgtgaaggaagaattattttagaatgcagaatttaagaaaatgaaacatgtcatattaaacgtcctttttcaggggcgcttttttttatgccttttttcagaagctataaaaaagaactgaacgcgggtcacaacacgttcagttgaaaatggatatatgtagaaaaaggcagacatgaccttagaactttgtgattgaaacagactggtgctgctgaatagcggcagatgaaactgccggcagcttatttgcagatggctccgttttcagcgtttactttcaccaattcagcttagcttccgttttgtttcagataaaagcgaataatagaaggggaagcgaaaaaaataaacacaggctgatacatctaaggagagactgcatcatgaataagttgaaaggcatcaagctgctgagtgcagacggcgagtctgcactcattgattctttaacgatggggcttcatcacggaacggttctcggggaagacaatatcgtcgagacatacattcgttctttgcgcgaaaagctgaaggacaaagaacacaaggtgattcgcacggttcggggcgccgggtacagggtggacctggcatgaaacggctgtacagaaccctgcggttccagctcctgttcaggtcactggcgattttgaccttgctgttatgtttcatcggcggtacacagtacatgtttatgagacggacgatgtatgaaaatcaggcgatcagcattcagagtgatatcaattcaatggatcaaagcgtatggaggtcaatcaaaacccctgcccgttccgaaacaccggctcatccgaatgtgatttatcccggggtgacggttgcttttatcaatcaatcatacaagatgtcagttttatcagaagacccgcacgcgggagccgctccttctttcccgaaaaacgtgtatcgggatgcgctgacagatacaatggcgcttcactatcaggtggctcacaataaggcgggtgaggaaatcatcgtcgtgtttcaggcgatttccgttgacggaaggcaggcgggagttgtacagatgagcacgctgacccagcctctgaatgattcgcttttccgccagatcagcattttcgcgatactttcctttgcggctttggttatcggactgtttgtttttttgccggtgatccggctcacactcaagccgctgtcccgcattgtgcatatgatgggtgacattcatgccggcagtctcgataaacggctgccgattgataggaagcaggccgaaattgagtcattgggcatctccatcaatcagatgctggaacggattgaaaccgcgtttcaggcggaaaaagaagcgaaggagcgcatccggcggtttgtatcagacgcatcacatgagctgagaacgccgcttacctccattcacggctttatcgaaattttaatgcgcggagcggcggaaaagccggagcagaaagaaaaagcgcttcaaagcatgtacgcggaatccgtcagggcgaataagctgatagaggatcttttgtttctcgcgaagattgaccgggagccgagctttgaaatgaaaaaaggggcattgggagacgtcattttggaaatggaggctgagctgaagctgcttgcgagaaaccggaaactcgagttctttgttgatcaaaagatagaagctgtttttgacaaagacaaaatgaagcaggccattctcaatctcttttacaatgcggtgcagcatacggatgaagacacgggtgtcatcaccgtctccctgcagaaagacggaggaatcatgcttatgattgcggataacggaacgggaatcgctccggagcatgtgcctcatgtgtttgaccggttttacagggcggaaacctcccgatcccgtcaatccggcggcgcggggctgggtcttgccattacaaaaaccattatcgacagccataacggaacaattgaagtgaaaagtgagcagggaaaaggctccgtgttcatcatccggctgccgggataaaccgggatagcggaagaaatatcacaatttatatataaattctaaattttcaaaaaataacttgtccttttccaatattgatgataatatctagttattggcaaagggggtgtgtactgatgaagattgaagaacttgatcttgatacagaaacagcaagcttggtgcatcgctgctagtaaagccgtgactcccctttttggggagttattatctttcagggggtatgtcatgatgtcaacggactgtaagcgctggaagtttaaagacagcgtgcaggtgctgacctacacggggcatattatcattcaatatcgaaaggcgattaagcttgcgcatacgagtgagatcaaagaggcggttgaacggctgatcaccggctgtgaaaaacaagagctttctgatcttctgggagaggaagcgggaaaccagtttttcgatgcgttaatgaaattggatgctttaatagagccatggcaaaacggccgtgaaggctgcatcactgaaaagcagctgtaccattttgagaaatacaaccaaaaccccaatctgatccaaaacagattagacggcagcagggcagcgatcgtgggtctggggggcgtcggaacgatcattcttcaaaaccttttggcggcgggcatgcagcattttattctcattgatttcgatgccgtatcagtacataacctgaacagacaattcgtctatactcaatcttctgtaggcaaattaaagatctcagaatgcagagattatatcgcgggtatcaatccccatgcggacgcagcactttaccatcaggaaatgacacagccgcaggacctgcgtgtgttagatccgtacgaaattgatatcgtcataaatgccgctgacaaaccccataacatttctgaatgggtttatcagtattgtaaggagcggaatatcgcgtttatgaccgggggtgtcggcagcttcagcggccaatgggggcctctgctcacgcctgaatcctatcaatccggcgtcacctatgaaaaaaacatgccggccggacttctgaactgttaccccgatgaaccgatcaaaggttcgttaggagcgacaaacggtattatatcctcgtttatgtctcatgacattatcacataccttgcaggcggaagcccgaaatccctgaatacccgcatcggcctggactttgacggacttcatattacagaaacgaagctttctcaaaaggaaagcgctttatgaagacgatgcatcgtacggcgagaaaaccgggcgaccctctgaaaatagaaatcgacacaagcccgatacgcttgaacccattagatacgcaggattacacaagcaagatgatttgcagcattatgtatgaaagcctgcaggacggctataactgccgaatcatccgcaaagatcgccgcacctgtcaggtggacattcacccggactatttaggtgacgccgagggtgtggttcaaacgatcatctatcatctgacaaaagaaaaccaaagtccccatctcggcagtttcctgaacataaaacaggccgttccgtatgtaaaaggcctcgtctcatccgatcagctcggggtgaacgtaacgggcgaaaaacgctttgaagtcaccttggacgagccgtctgatgaaatagaagccgttttgcagagcagctttctgattccggcgaccgccgggggcgatgtgccggaaaatggcccgtaccgattcaagcgtacgtttgagaagggactggaatttgagcggaatccgcaatataaaatgacgcccgcggatcaccgcaccgttcagatcatccaatttattttgaatgatgatctggaaaaaagcatctggctgtacgaagcgaatcagaccgatgtgacctgccacacccagtttcatcattccaacatgaggtatcggcagtatgctgattttaaagaaaatcatttgccgatgttatttaccttcaaggtaaaggacggcatgctgagaactttcattcagcattattttgataaacaaaagctggccggcgatttggggcatatcatcacaccgactgattcactgatcggtatatgggaaagcggacggacaccgcagaaagatccgccccttttgacaaaagaagagccgatccgaattgtttatgccgattattatcccaacggagagatcattgaaaggctgactgaattgtttcggagggccggagcggacgtatccgtctcccgcgtcagtcatttcaatgattattaccatatggataaaagcgggtttgatattgagcttcatttgttcctgccggcttacatgcatgagctgagctatatcaaatatttcattcgcgacatcagcgatccggggaagaaaaaaacgatcattgatgccataggatctgaaaaaaagaaggaactttttgggttattcgagaatacaactcattattgcccaatttgttttgggaaaagtctgtatctgcaagatccatgtatagagggttttagtgtaaagactgacgggctcctttctgttcatgatgttaaatgcagatagctggaaaggggtattcatttgcggaatcgaaatttgctttacttctccggttttttcggaaacttctttttcgaacggggaatttggattttatatttaacaagcatgaattattcattgtttctagtgggcatcctgcaatcggtcctgaatttggcgatgtttctggcggaagtgccgagcggcgtcatctcggacagaatcgggagaaaaaaatcgctcttgctcggtcattttatggtcattgtctatttggtgatgttcctgagcttccataacttcatcgccctcttcatcgctcatattatatacggtatcgggctgacgtttatatcaggaacggatcacgcctttttgtttgattcactgaaagaacaagggaaagaaaagtggtacggcaaatccatcggaaattataacggacttgtcatactcggtcttgcgatcgccatgggcatcggcggctacttgcaggaaatatcatggtcgtatgtgtttatcgccgggattgtgactcagctgattgcgatggcggtcattacacagctgacggagatcaaatttgaaaacagtgaacacgaaacgcagacggtcggggacatcttaaaagaagtcaaagatttcttcaggctgaacaaagcctttaaatatttggtgctgtcactctccgttttctttgcgattacatcggttttttatatgtacggacaagatctgttaagtcaggaagggctgtccgtgcgcaatatatccattatttttgcggggctgtccatcttgcaggcactgtgctccatcttttcttcaaagccggcggaaaaattcacgccgaggcgcgtgcttctgctgacattctgcatcatcggggcggcctatctgtttataccttcgggcagtctgtacgtgacgattgcagcttttgttgtcatcaacgcgctctatgatgtgatagaacccgtatccagtcaggtggtgaataatgagattccgtccagaacgagagccacgctgctgtccattatcagtttgatgacctcgctcttcatgttcattgcctttccgtttatcggattcttaacggactattttgattcagctttgctgctgaccgcaatcggggtattatccatcttattgtcgctgtttatgatgctcagcttttacaaactgaaagcgagcgtcgccatccagaataaagtcgagctttgaaccagaatgacaaagggatgatgtgagttgctgaatattcataatcttacggtaaatttagcgggagataccattttcaaacaagtttctttcttcatcaatgaaggcgaaaaagtgcttgtggccgggccgaacggttccggcaaaagcacgctgttcagggtgctttcaggggagcttgaggcggatgaaggaacgattgcgatcaacaaaggggcgaaggtcggtttgctgaagcagatcgctgatccccatgaggatctgacgttgtatcaatatctggaaaaatcgtttgaagctctcgcggcgatccagaaggaaatgaaggccattgagctgaagctttcggaaccgatgggtgaggacgagctgactgctttattggaaaagtacagtcaatacacggaaacatttgagcggaacaacggctaccagatgcatgcgatgattgacgaggtatgcaacgggctcagcctcagcgaattaaaggatcagccgttttcaaagctgagcggcggcgaaaaaacaaaagccggccttgccgaaattttaatccgcaacgacgacattatactgctggacgagccgaccaaccatttggatgttcatgcgattgagtggcttgaagggtttattaaaaaatcgaataaaaccattctgtttacgacccacgataaaacgtttgccgaccagacggcgatgaaagtgctcgagattgacgataccgaggtgaagatttggccttacggtttcagcgaatacctgaaaaagcgggaagaattcatcatcgcccagtttgagaaatatgaagaacagcagagaaaaatacagaagatgaaggaatccatcgcccagctgagagattgggccaaccgctcgaatccgccgtctgtcgggctgcacagacgcgcgaataatatggaaaaggcgctgaaaaggatcgagctgatcaataagccggtccggacggagcaaaaattaaaaaacgcatttcaggaagcgggcgccggttcaaaagatattgtgttcattgaaaacggaaaggtggccaacggatcttcccttttatatcaaaatgtgaatctgcgtataaagcataaagacagaatcggcatcgtcggcagaaacggcgtcggcaaaacaacgctgatccgctgcatcatcggggaaagagaactgtcggacggcaccattaaagtaggggaaaatcttaagataggctacattgatcaaaagagccacgtcggagattcgagtcagacgattctgcaattctttaaagaaaatctgctgactgaagagggcatggcccggaatatgctggccaagtacggattttacgggtcgtcggtctttaaaaaactttccgtcctgtcgggcggtgagagaatcaggctgaagctgtccatcttaatggaaaaaaagctgaatgtcctgatcctggatgagccgaccaaccacttggatattgaatctcaggaaattctcgaaaacagcctgatgcagtttcaaggcaccatcatctgcgtttctcacgacagaaacctgctggagaagttcaacaagattttctggcttgagaatcaaaacgtcaccatcttttcaggtccatacagttacgccaaacaaaaaaaacggcagattgccgaataaaaggggaatggatatgaccattgacagactgacaatcaatgagttatcgtacgatctttttgtaagcgagtatgctgataagaaaccttttattttgacgggggcaatggatcactgggaatgcaggccgtggacgcttgaatacattgacgaacactatggagacagaatggtcaccatccggaaatcagatatcgaaggggtcaaaacgtttaaacaagtaaagctttccaactatatcgagtacattgatcagaatgatgacaaatggtactgtgactggaattttacgcagctgaaccaaaatgacttagaccttgtctattccgcacccgagtattttacaaaagacacattgagagcggatgaagaaacgggacgggactggaaatggttctttctcggttctaagcagacaggcacgccgctgcatcaggattttaacagcacgcacgcgtggaacggcgtcattttcggggagaaggaatggattttctatcatccggacgactctccgtatttgtacgaaggaaatatcaatgtctttgatgaaaaagatatagagcaaaaaccgctggcgcaaaaggcgtctccgatccgcttcaggcaaaaggcgggagaaatcatttacgcgccgcgccattggtggcatcaagtcgagaatacggaacatacattggcagtgagtgagaacttttggtttaccggagagcggcttgccaatcagatataaacgaaaggctgaggagcacctcagcctttttttgtatggattcatttcatccggtccagaccgaattttttcaggcggtattgcaggctctgcctgctgattccgagctcgtttgccgttttggatatgttattgccttgttttctcagggttttttcgatcatgtatttttcgaagttttccattttgtcttttaaatctgtgccgggctgggtgcttgcggctgctttgctttccgtgtcagcgggtttgattttcatccggtattggtaaggcaggtgggccgccgtaatcgtcgtttcatccgtcataaagttcatggcgccttcaatcatatgttcaagctcgcggatgttgcccggccagtcatactccaggaaaaattgctgcacatcgtcactgatcgaatcgacatgcatttgaaacaggtggttgtttttctgaataaacacttcggccagaggcagaatgtcttccttgcgctcccggagcgggggaatgatcagcgtgacaacgcttaagcggtagtataaatctttgcgcagccgctcttctgaaatggcggtgatcgggtcttcattcatcgtggcgatgatacggacgtcaatcggtttgtcctgagctgatccgatgcgcctgattttcttttcctgaagggcgcggagcagttttgcctgcaggctgagattgagagagttgatctcatcgaggagcagggtgcctccctgcgcctgctcaaataagccgggctggtcgatggctccggtaaaggcgccttttttcgtgccgaataaaatactttcgaccagactgtccggcagggcggcgcagttttgtgagatgaacggggcgcctgagcgctggctgccgttgtgaatgctttgggcgaacagctccttgcctgttcccgtctcgccggccaaaagcacggacgatgatgtacgggttgcccgtttcgcgttttcgatgacttcctgaatgaccgggctgttgccgagaatgctgtcaaacgtgtagctgttctgttcttttctgtgcatgttctccctgatcagccgttcgagcttggtgacgtccttggcgatttccacggcgcccttgatctcgccgttttgcacaatcgggaaggtgtggttgatcgtcgtgatttcctggcctttgttattgaaatagctctgctttacatttttaatcgttttgccttcttgaagggcctgaacgagcgtgctgtcctgctgattggaaaacataaatacatcagtcaggtttttatgcaggacgtcccgttcatccatatcttcaatctgcatcattttcttattgtaaatgacggtgctgcccttctcatccaccacatgcagcccgacatcaatctcttccagaatgctttgtaacacgagtgtgtaaaattcgctggttgtgtgcaggtcaattccccctctcaatcgtcttaacattcattattttaaaataaatcgaacaggaaacgcaaaaaaattttgcgcttggctgaagtttgcacgcaaactgccggaatattttgcaggaaaagaaagaatgctggcgaaacatcccgttttttcggattggcacggaacttgctttataaaaagggaaagcaagatctaatgttgaatgattacaaaacaagggggaatcagattatgtcagctttcacaaaatctcaagaaattatcagtcaaacttcacattacggcgcgaacaactatcatcctctgccgattgttatttccgaagcgcagggtgtttgggtaaaagaccctgaaggcaatcaatatatggatatgctgagtgcttattccgcggtgaaccaggggcacagacatccgaagatcattcaggcgctgaaggatcaggcggataaaatcactctgacgtcacgcgcgttccataatgatcagctcggcccgttttatgagaaaacagccaagctgaccggaaaagatatgattctgccgatgaatacgggggcggaagccgttgaatccgctgtcaaagcggcgagacgctgggcatatgaggtcaaaggagtagcggataatcaggcggaaatcattgcgtgtatcggcaacttccacggcagaacgatgcttgcggtatccctttcttcagaagatgagtataaacgcggtttcggacctatgcttccgggtataaaattaattccatacggggacgcagaagcgctgcgccgggcgatcacgccgaacacagccgctttcttattcgaaccgattcagggagaagcgggcatcgtcattccgccggaaggatttttacaagaagcggccgctatttgtaaggaagaaaatgtgcttctgatcgctgatgaaattcagacgggactcggccgcacagggaaaacattcgcggttgattgggaaaatatcgtaccggatatgttcatcttaggcaaagcgctcggcgggggcgtcttcccgatttcgtgcatcgcggcgaaccgtgacattctcggcgtgtttaacccgggttcccacggctcgacattcggcggaaacccgctcgcttgcgcggtatcgctcgcatctcttgaagtccttgaggaagaagggctggcagagcgttcccttcagcttggccggtattttaaagaagagcttgagaaaattgataacccgatcataaaagacgtgcgcggacgcggcctgtttatcggtgttgaactgacagaagcggcccgcccgtactgtgaaaagctgaaaggcgaagggcttttatgcaaagaaacacatgataccgtgatccgttttgcaccgccgttaatgatttccaaggaagacttggactgggcgatccaaaagatcacaaacgtgcttcaaaacgcgtaataccttgatgcggcaatgctttccctcggcttgtatggaatttacaaataaaaaattcagcacactctatttgcgcggagacagtattttagtataatgtatctttatgtacgaaaatgaatttcatataacattcatatacaaatagaggctctttggacagcaaatcggtttcaaagcaccggcttggttccaatacaagttgctgaaggggtgcagaatagtgaatacaaatcaaaaagagaatcagcttcagcgcacaatgaaatcgcgccatttgtttatgatttcattaggcggagtgatcggcaccgggtttttcctgagtaccggatttacaattaaccaggcgggaccgctgggcgcggttctgtcttatctggtcggcggttttattatgtttttgacaatgctctgcttaggcgagcttgcggttgcccttcccgtatcagggtcgtttcagacgtacgcaaccaaattcatcagccccgctttcggtttcgcattcggctggctgtactggctcggctgggcggtgacatgcgccattgagtttttatctgcgggacaattgatgctccgctggtttccgcatgttcccgtatgggtgtggtgcctcgtgtttgtcggactgatgtttcttttgaacgcgattaccacaaaagcgttcgctgagtcggaattttggttttccggcattaaaattttagtcattctgctgtttattattttgggcggtgccgccatgttcggcctgatcgacatgaaacacggcgagcaggctcctttcttctctcatttttatgaggatggattgtttccgaacggcattaaggctatgcttattacgatgattaccgtaaacttcgcgttccagggaacggagctgatcggggttgccgcgggagaaagtgaaaatcccgagaaaacgattccgcgctctatccggcagacggtatggagaacgcttgtctttttcgttctctccatcatcgtcattgccggcatgattccgtggaagaaggcgggagtggtcgaaagcccgtttgtcgtggtgtttgaacaaatcggtattccatatgcggccgatattatgaactttgttatcttaattgcgctgctctcagtggccaactcaggcctgtttgcatcgacgcgtatcttatatgccatggcgaacgaaggacaagcctttaaatcgctcggcaaaacaactaaacgcggcgtgccgatgaacgctctgatcgtgacgctggccgtcgcctgcctgtccctgctgtctaaagtggcagcgccggaaaccgtttatatgtttctcttatcattagccggactaagcgcgcaggtcggctggattacgatttccctgtcacagctgatgttcagacggaaatacatccgcgaaggcggcaaagtggaagacctgaagtttaaaacaccgctgtacccggtgctgcctattatcgggctgacgttaaatacggtcgttctgatcagtctcgcatttgattcagaacagcggctcgccctttattgcggcatcccgttcatggcggtgtgcgttatcgtctatcatctgtatgtaaaaaagcataagcagtcagaaaaacagatagagctttaaatcttttcgtgtccaagtcatctttgagaaacccgcacaggacaacatacaacatgttgaggtggaaaaacggatgaacaagaatatctcagttattggaatgccgatggatttaggacaagcacgacgcggagtggacatgggcccgagcgccatccgctacgcgcatctcattgaacggttatctgacatggggtatgcggtggaagacttaggcgacatccccgtcaatcgtgaaaaactcaaacatgatgaagagctgaaaaatttgaactctgtgctctcggggaacgagcagctcgcccaaaaggtggacagcgtcattgagaatgagcggttccctctcgtcttgggcggcgatcacagcatcgcgatcggaacgctgacaggaacggcaaagcactataaacagctcggcgtcatctggtacgacgcgcacggcgacttaaacaccctggaaacatcgccgtcaggcaatattcacggaatgccgctggccgtcagcctcggcgtcgggcacgacacgttggtgaatctgggcgggtatgccccgaaaatcaagccggagaacgtcgtcatcatcggcgcgagatcgcttgatgaaggcgagcgtgaatacattaaggaaacaggcatgaaagtctatacgatgcatgagattgaccgcctcggcatgacaaaggtcattgaagaaaccattgactacctgtcagactgtgacggcgttcacctcagccttgatctagacggccttgatccgagcgacgcacccggcgtaggcacgcctgtcgtcggcggcatcagctaccgtgaaagccatttggcaatggaaatgctgtatgatgccgacatcatcacttcagctgaatttgtcgaagtcaacccgatcctcgatcacaaaaacaaaaccggcaaaacagcggtcgagctggtagaatctttgttaggaaaaaaactattataaaatatgcgcctccgcacctgcggaggttttttttgttgccacgaggaaactagcgggctgccaccctctttttggacctgtaaatatgatatatttattacacaaaatgggaaagggaggtgtcctgacagatggctgaggtgatggcccacgaaacagttgcgaaaaaaatcagtgactggtatgaggaaatcaaaaagcacaacactgaatcggctgaggcgttaagagaacaactgcttacggatctgcaaaatatgacacaaaatcaaacggtgctcctttattttaatttaattgattcccgctataagcttttaatggaagagtatgagaaaacagacggcattttaaaaacgatccagctgaacgccgataaagaaaaaacagaccagatgattcaatactattattatttcttttccggaatgcacgagttttaccgtaaacggtttatgaacgccattaatttttaccggattgctgaaagcaggctccggcacataccgaatgagattgaaagagccgagtttaattatcaagtggcgattgcctactatgaaatccgccaaaactactttgcgatgaaccacgcggaaaaagcgttggagatctacaaagccaatgaaatgtacgcggtcagagaagcacagtgtttaatggtgatcggctgtaacagaatggacttgttccactatcagaaagccgaagagctcctgcagacggcggttcatcaagccgccaaagcgggcgatccgcatattgaagcgctcgcccactttaacgcaggcatttgctatgaaagacaggaaaaactggaagaggcgcgggtcgagtttgaaacggctcttgatcaaaaggagcatttgcgatcagcgtattcggtgcggagtctgtacatgctggccagagtgttattgaagcaggcaaagacggatgagggccgattttggctgcataaagcgctgaatgccgctgaagaaaaaaacgagcccgtatacacccaaaagctgcgcatcttacagcatgtctttattgaccgcaatgaagaagcgcttgaatcagctttcgccgagttaagaaggaaagagctgtggagtgacgtttccgatttgtcgtatcaggccgcggcgcattttaaaaaacaggagaaatacaaaccggcggcgaagtattttcaggaatcaattgatgccaatgaccaaattttgagattaacggaggggattcgtaatgaaaacatgtaaattcattgtactctcagcagccttggcaagtctcatttcgattggattatttgcacaaactggttcaacggcacaagccgaacaaatcataaaaccggcggaaaacggagccttcggataatactgcatgatatcgctttcgtgtaaggagtgattcaatggctatcacgctgcagccgatgacaggacaagagtttcagtcctatctcgctcattcaaccaagcattacgctgaagaaaaggtaaaagcgggaacgtggctgcctgacgaagcgccggaattagcggagctgacgtttgaagacctgcttccagacggcttggagacagccgatcactatttatggacgctgacattggacggaaaggaaaatgccggctggttgtggctgcacgccgatccggaccacccgcagcaggacgcatttatttatgatttcggccttcatccgcctttccgcggcaaaggctatgcaaaagaggcgctcgcaaggctggaggacaaagccaaagatctgggtgtccgcaagatttctctccatgtgttcgctcataacgaaacggcgcggaagctgtatgagaagacgggattcctggagacggatgtcattatgagcaaaaagctgtcatgaaaagaggcccgcacgatgggcctcttttgttattcatctaacaatgtcatcatttgttccgggtaacgctcgccggccgccgtgccgatcggaaacatttcatccaaccgcgccttcacatcctccggaagcacaatgtcgagagcggcgaggttctcttccaagtagtgtttcttttttgtacccggaatcggaatgaggtcatcgccgtttgcgagaacccatgcgagcgcaagctgaggcgcggtgatattcatttcccgggcaatggcggtaaatttttggacgagccctatattcaccgccaaattgtctccctggaatctcggcgttcttcttctgtaatcatcggcatccagctgatctgtcgacgtcatctttccggaaagaaaacctctgccgagcggactgtaaggcacaaatgagatgccgagctcacggcaggcgggcagcacatgctcctctgcttccctgctccataaagaatattccgattgaagcgcggcaatcgggtgaatgcggacggcgcgcctgatcgtttctgcggaagcctctgacaatccgatatacctcacttttccttcgtcaatcagcttcttcatggcgccgacagtttcttcaatcggcacccgcggatcaacccggtgcagataataaaggtcgatataatccgtcccaaggcgtttcagactggcatcacacgcttttttcacataatcgggccgtccgttgatttcgataaactcacccttttcgcttcggacataaccgaatttcgtcgcgaggcacagctcctttctgaatggggcgagcgctctgccgacaagttcttcatttgcacccaatccatattgatcagccgtatcaaacaaattcacgccgagatgaacggcatgatgcagtgtggagatcgactcttcctcactctggctgccatagtattccgacatgcccatgcaccctaatcccattgcggaaacccgcatcgaaccgatcgttctgtccttcatatgtcctccccctttcttgtatgataaccagatttcctgatatttgaaaatgatttatgtatatgatttacatattgttataaaatttttaaaaatctgtaaattgtatatttttttatcacaatttcgtcatataatgaaaacgtggaaaaattaacctttgagaaaagaggcgaagtcaatgtgtaaaaagctgttcaaagccgtcctcccgtttgccctgtcattcaccatggttctgtcgttctccggtttgaatgtaaaagcgaaagaaacagaaataccacgctacgcaaaagaaatcgcagaccttcagcagggcacgactcctcaagacgttctccaatccgccaaagagcttgccaaacagaagcacgtttcaacagaagcaattctcaagcagtttcatcaagaaatcacggcagacaaggtgcaaggaaatgtaatcgcttccaaagacggactctctgcgatgggcggatcgtcaggaaccaaaaaactcccgaaaagcacaaaaggcaatatttattacacgaactcatacacggcttattacaatcacgggcatgtcggcatgtattcatccgctgataaaattgtcgaatccgtgccgggagacggcgtccgtcagattgcttataacggcagagaagtcgaagacaattcaatcgtccagaccgtgaaagttaccgatgctcaaaaacaagccgccgctgactgggccgtatcaagagtgggtgatgagtactccttcaacttcgtcaataacagaaatacgggccatgaaggcgccaaaaactgctcaaaactgctgtggtcggcattccttttaaaagcggggattgatatcgactctaacggcggcttaggcgtatacccgcgcgacatcacaagctcgtcctacacaaccacgatcctgaccattcactaaggagaacaacgtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgttgctgtatttctccactgcggctgaccaagacacgttcggcggcggaaaaagctacgccctcttcgccgatgaaaaagggcggctttcttcttatcaaatgaaggggcttgagctcggatcggccaaagtgcatgacgaaagcgtgctgctggaggacaaaaaaggaatctacaccgttcaggacggccttcacacgtataaaagagcgtaccagcatacgggagacagcgcgggatatatcgaacgggcgaaaggcttttacacgctgtataattcgggctacgacaagagcggcggcagctatcgctcagagctgtaccgccagatggacggcaggtggaagcaagacgtcatcccgcactatatccgcgcctcaggcttttttaaagatcatcttttcgcgctcacgccgacagatgacgaaaaaggctatcacgtccaagacattcaggccgataaagaaaagctccatacaacatcaatcgcgacgtggacgtataaagaaggcacgtctgtcgaatcccagctcgccgtggacgacagcgctgtctgctttgttaccagaggagaaaaagccgatcacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcatcgcagcttctatttcgttgacggcttcggaaccgtctaccgcatcaaccctgagaccggaaaaagcaaaaaggccttcaccctccccgcatcacgaatgaaggccgacttcaaggagctgacccatcaaaacggaaagctgtatctgttcacgtacagctacaaaaagcccgccaaaatcgaatccttcgacctgaaaacgggcaaaaagctgaacgacctgaccatcccaaacttaaaaaacatcgtcacgccgaaaagccatctcaagctgtatgatgtgcaggtgatggatgggttttaaagagtatgaacatttcggaagagcttgccgcttttggtaagctttttataatgaaacgttactgcgggaaagaaggtgttcatttgaaatcattcagtatcttcttattgttgtccgtcatttgtataaccattgtttttgtcataatgaatatgttgattggataccctgatgtgagtaacggggcattgattatgattgtatatatcgttgtgaccctcatgataaggctatatagcaagaaaaagaaatagaggaatttgaaccgtaaaagcagaagacagtcagatgaaggagggagccgatgaagaaaaagcttgccgcggtgaccgtcaccattctcctggtttccgtgataaccaactcttttttaaacggcggaaagccggactggattgatgtatgctgtacgctgctggcgtgtctattaggaattctgttcgtccttcgcttagaaaaaagagaaaacacgtaaagagccggatgctgaaaacaccggctctttttgcgcgtgatttgccgaattgtggataaaactcagcccgaagcactactaacatgtgtataaataggttatattgaaaagagaacaattgccgcgcgcaaaagaaaaccggaggatgtaacaatgaaaaccgcttattattcttgtgaagaacatatcgaaaccgtgctggacatgtacatagatgatcatgagcttccgcccgaaatcagaaaaatcgaacatactaacagtttatccacagcctgtgaattatgtggggacactgcaacatatctagtagggaacgaatgatcctacacaaaatacagaaaagatatccacaattgtggacaatatatatgaataacttgtttctaaagtggggatgacctgtgaatatcaatattgtgaccatcggaaaactaaaagaaaaatacctcaagcaaggcattgaagaatacaaaaaacgactctcagcctacgcaaaaatcgacatcatcgaactcccggacgaaaaagcgccggaaaacctgagcgaccaagacatgaaaatcgtcaaagacaaagaaggcgaacgcatcctggccaaaatcagcccggacacccacgtcatcgccctcgccatcgaaggaaaaatgaaaacatccgaagaactggccgatacaatagataagctggcgacttatggaaaaagcaaaatcaccttcgtcatcggcggctcactcggcctaagcgacgccgtcatgaagcgcgcagacgacaaactgtcattctcaaaaatgacatttcctcatcagctcatgcggctcatactagttgagcagatttaccgggcgtttcggattaatcgtggggagccttatcataagtgagtgaggtttgcaaataccattttcttgatgtattcagcataaaaataatcgttaaggatcatattttgttataatatattcatatggaaatattatgaatgaaaggatgaccattttggaaagaaaaatagatttacttatgaactcgcgtttcggggagagggtagccgaagaggatgagaatttagcatcgtattttgttgaaacggcagtatggaatcaattgttgatgggggaaattgatgtagtccgaggagtgaaaggttcaggtaaaagtgcattatatatgcaattattaaaaaaagagggtagttttgctgcgaaaaacaccttattaatacctgcagaaaacctagagggcacacctgtttttaaatctgttcttggtgatgctgatttaactgaaacctcgtttcagtacctatggtctatctatatcattactctgataggtgataaaatcaaagattttcgtaatagaagcgaagaagtaaaagattttattagaagacttgaattagaaggtttattagaaggtaaagggataagacgtctccttacgaatgttagagattatgtttttgaattctttagaaatgtaaaagaagttgaaggagtagtaaccgtagaacctacaactaatatacctattttaaaagggaaaatctctttaaatgaaccaagtaaagaacatagagaattaggagctatatcaatttttgaacttcttgaaatggctaatgaggcacttaaaagtgttgacttaagcgtttggataacatttgatagacttgatgtagcatttcccggaaaacctgaatttgaaaccttagctctaagaacactttttcaggtttacaataatataaaactgcacaaacatataaaattaaaaatctttattagagaggatatttggaaacgaattactaaaacgggttttagggaggcaagtcatataacaaagcaagtgacgattgattggtcagaacaggattttttacatttactggttagtcgtattcttgaaaacgatattctttgcaaattttttaatgtggaaaaagatgatgtattaaaagatagtgacaagcagaaaaaaatattctattctattttcccgaaaaaagttgaagtaggaaagaatcctgaaacatttaaatggatgattggacgggttaaggatggattaaaaataacagctccaagagaactcattcatttaatgaatgaggctagggcaaaacaaattaaattgttagaaactggtactccagaaaactcttattcagaaatcataggacgaagtgctttgaaggacgcattaaaagtagtatccaaaattcgtttagagcaaacaatttatgcagaatatgcacatctaaaaaaatacatagaaaaacttgaagaccagaaaactgaacatgatgttggtaccctttcaaaaatatttctaataaacaaagaagatacaataaatattgcaaatgaattagtgtctattggattttttgaggaaaaaaagggtagtcataaaccttattggacaccatttctatacagagccggacttaatatggttcaaggtaaggaagactaatattatagagataagagtaaagggggagtataaagcttccctattaattttttatgcttaagtaactctatattagatttaaaaaaattcacataaagctacatcaattctcaactgtcattagtcttaattaagcttgttaccatagggatgtttcgaagactttaatcaaaaatgattcaaatctcacttagatagagactatgataaattttatattatttaagtcgtcatttaattaacgtttattacaatagaaatataatctatagagggtgttgaaatttgaagaatgacattttgttacctaataaaattaaagtttttataagttcaaggtgtggacaaggttttgaaaggtatgatgaagtaagaaaacaactaaaaaaacttatcgaatcgacaaagattgctgatgtatatctatttgaggaaagtggagcttcgacacagtccgcagaacaggattatttatatgccctagatgatagtgatgtatgtctattcttaatagataataaagatgatgttacatctgcaattgttagagaaataactagagccaaatcacacccaaaaaagtcaatatatctattttgtaatgaaaaagaaagtaaacctacgcaaatccaagaagaacttattggagcaaaaggagctaaatattatatagttaatagttttaatgaatttgcaaatcaaggatttaaagatttaataacagacatatgtaatatttatagacactattgtaaaaatagactcatagaccaagaatttcacaattctgaacagaataaaatagaaataggttcaatagcttctgaatcactagagaaacgtattttacaaggaattgataaatcaaaagcatatatcggaaaaaagatattttctgttaataaagaagtgaaagaaacgagtgaattagatagattttatgagcaatttctaaaagtattatttggtgaaaaaagtattgaagaattcaatggggatttatttttagagcaaataaaaaaagagcaaagtgataatatgcatctagtagtaaaattaagatggaaagctattcagttttactggctcgatgattttgattctgtattaaaatacttaaaggaagcttttgacttatgtaaggaaagtgggttgcctgattggatttcacaggatatactgatagatttaataaatatagaaaatcaaaagttaaatcaggaaaataaattctcctctaggaatgctgcacaagaagagttagaaagtatgcgtcaatctctgttttacccatcaattgatagatatgaaaagctattatataaagaaattaataaagcatcaacaaaaaagaaaactgaaactgtgtatactgttaaccttggtagtaatttagatgtttatattaaatatttgactaacatttatattgttggtgcctttaatggatctttaactcaattattattattgagaaataaaataaaagatatatcatttcaattatgtgaggaatattccaattgggaattcagagtgttgctgttaaaaatggcagtaatagttggagatagcaagcaaacagaaaatataatttcctactttaatagcatattaggaaaaatcaattatattgatgtaaaaaatatttataattttacaaactgcctcccggtaaaatcagaaagaataaaatctaagctagaagtatttaaacatttagggtattattttagcgatgaagattacatgtgtatcaaaagagagttattggaagagattcataattatattgataatacttttatagtgtctatgggaaaattaatatttgattctttgaaagaaaatatcaatagaatcgaagccgatgaaatatctagagtatgcataaaaattttagaaaaaaagatgtttcgcttttatgatgatgctttaaatttgataggaataataagttttaaagggatatctactcaaaaccttgaaaaaataaagaatttgttgaaaggaatcattttagattctaatctagcaaaccagtgtcataacctcttatatgcaattataaatttaagaaaacagataatagcgggtacttcggaattaaatcaagttgtattaagtaacatgtctgaatcagatcgcaaaatttataatttagaaacatctagtgtcaaaagagaaagccatattatgagttatgttcaggagatcaaggaacaaattgagaaacaaggtaaaaatgggatttacagtgtgaaagcgcaaaacccatatctaataatccaaaatatcattaaagagggttgtgaaatagttgataactatctattaaatgaagttcttcaagtatgtaatgaatcgttatgtgcaactaatctactgtattctgataaggtgagtgctttacaattaactatttatattaaacagaatttccaaaatattgattataattttaaagatttatatcaatatttgattaaacacgaaaaccatctctttgaaggaaaagatgatctttttcaaaaatattcgacattaaccgtaaagattaattattttatgcttaaaatggtatgttgccaactagataatgttgatttattaaatctattaagtgaaattaataatgaggatgagtttgaaaaaatccaatgcttaaaggccattataaatgctataaataatgaatcatttaaaaatatagaatcagatattcgtagtatcattattcaattcactttaagtttgaagaatgacaaaaatcaagatatacggtatttatcaattaaagcattgctaaaaatgataacaaccaaaactcaaaaagttatactgactcagctttcacaatctatggattatgaaaatgtatatataaaaaatcttataataggaaactttgaaaaattagcaattatagattccaaagttaataatttaatattgaagaaagcttccatagataatcattatttggttaggacagaagcacaaaaatatatacagactagagcaattaatattactcaataaacttgtttagaaaaaaagagataataaatgtgaatcaaataatttactttcaaatttgaaaacaaattattaaggagtaaatacatgaaagaagaaatgattttaagaaaggtgatttattttttatcaacggcagaaacaccaagggaagtatttttagtatggaataagcacaaggaacatttaaaatactttaagttgagtataaacctagataattatgataaagatactttcccggttggattgggagaattggtaaatgcagttgatcaagactttatttcttactttcaaaccggaaagttatattacatggatgatgaattactgaatgatatgttatttaatggaagtatatcatttcctattgactattctgtgatgttagatactaattatgctagttatattcctcgctttttgaacaatcaagggagtagtgaatttgagaaagaaagtatttacaaaactatagatactctactaaaacataaatttcattatgattataatttctatttagtagaaaattataataaaattattaaagataatgggagttttgatgcttctataaaaaaacatagggatatgtacgagaatttagtatttttagagctatttaaaagcattgataatgatatatacataaataagaatattattgaataccaaatttcgaagtttgaggctatccaaagagtagacgatataatatataaattatataaaactagggatggtaaaagttcattaaagaagttcttagatatgcatcagaatttaacattacttctgatcggaattatcaaaatacagttcagttcaaaaaaaaatgcaaaaaataaaatgattaagttacttgaatatgtccaaaataaagtaggaatttattatgaaagagaaatggttattgcgcttaaatatttcaagaatcctaaatctgttgggatatttaataaaattaataaaggtggtaatcaaaaaaaattactcgaaaaaattgaaaacacagcttgggattttatggctccgagggtaatggaatatttctctaacttgaatagtgaaggaagatattttataccatttttcttatcccacgacaaaaacttgagagagcttttaactttatttgaaattaaaggggttttacaagatattagaacgggtcagttaataccattcacaaaaatctcaagtgctgagctctttaaaaatgaaggagtagaaatagatctttctttctattctcaggaatccacaaataaaagacgattaatatatgaaaagaatattaacgaaggttttagaattctgcaagatgaattctctgagttgaatgacataatgaattaattggagcctctctatattattttacatttaatttttatgttattttatatagcatgttaacagacctaggtataaaacgctggttttgttaatccctctgtgctgtataggcaataggataaacacattattattcctttgcggggaagttatataaatgcatttgctaaaagtgaatttaaagtgattattctactaaccgtacaagaaaataatacccatatcgcagtaaactgtgacggctaaatatttctagggagataaagccttgagtttaatcaatcggatgctcttatgtcaaaggaaaatactttttatataaagactcggtaaaccaagatcataagtcccgattatcttgtatagcaggccgatttgttgtcaatattcgatttactatgaaatcacttgttggcttatagtgaacaaaacaaaaaaaccagatccactaaaatctggttccccacagctgattagaagcaacctactgttgcttctctttcaccatctttataaagagaaagaagacaatgaatacaataaaataattcaatggattcttaacgatacttatctccagcgaaatctgtaagagtatccagagaatgaagatggctagtattgaaggaatgatgattttgtacatgtcgaccaccttccatagttagtaaaagaaaggggcgcgggccctttttttttcatgattaaaagcaagatgcggcagctcccgtcattgcaccgccaacagcgccggtaattgctccgacggcacccgctcctactgttccgatgccgggtattgtgactgttcctacagcagctcctgcaagacccagtgtgccgccgccagttaccgcaccgccgccagtacctagaatacatttcccgactgattgggtgctgattgacccgcttgtttttccagcgtctttgtttacgactttgactaaaacgccatttttgattttttcatatttcagtgtaacggggtcaccatttttgtcagtagagcttttcggaagagcctgctcctcgcccgttatgttgtcttttagggttgcattgcctttagcgtcaatatgaacatctgcatgattgaacgtcatcttcagctcactgtcgttgaggttttcaactttgtatgtagcttgggaacctgcggcagccgcagcatgaggtaaaaccgggagggcaaaggcacctgctaggaataccaaggctgccagtttcactgcggttagcttcattctgctttgcataattgatcctcctcctttggttgccatactaacaaaggcattctgcttgttaaagccttaccatataaaatgataaaaaattcacccaatttcatcacattaaccaacaaggtttgtatgtttcccttcgaaagtcataggagagcagggttcatatctgatgcgaagttatcaaggaggatagaaaccgtaaagaagagctcagagaagcacctttattgcgaacaacagcttcttccgcattttccacacgacagtataaatccctttccgtcacggaaacctagtggaaaaggtttctgaaaggaggggcgtatgatgaaaagtgaaaaaattcaaaacaaaacatctttggtttggaagatggcgattgcctctgcggtttcttgggaagcggcaaaactggcgggctctgatcacccctatttagcgcctctgtctgttatcttatgtttgcagccaacgatagatcagtcgattcgtttttcttttcatcgtattgcgggaactgcgattgggatcatgctaacgtcctttcttgtcagtcacttgccaatgaatggctggatgctggggctgttcctattaggcgggacttacattgcaaagtggttacgaatagatgtaacggttctgcatcaggtagcgctcaccattttattggtctttacgtttgaacgaaactctaaagattatgcattcgaccgaatcatcgatacggtgatcggcgtcatcatcgccattctgattcacatgttcctttttccgccggactacacaaaaaaggcagcggactcttttcaaacattggcccgtcagctttccgacgcactttcagacctttccaaatgggtgcaatcagagtggggacaaggaaaagggaaccttatggaatataaaatgaaccatcttctgcaggagctgcatacggcaaaagagatgctgcaaacagcctctgacagcttaaaattcaaccccgtcagaaaaaaacataaaaacatcatttcaagctatcaaatagagatgcaaaagttgaacgccggatttgagtatctgtcaaatatagtgaaaacgttaaaagaatgggaaaaagaaggagctttatcttcaagtgataaaagggagctggggaatgatttacaagtgttaagtgaatacttttcggatcttaaaggcatacagcagggtgaaacagacaatcggaaacagaaggaacagaacgtgttattggaatctctccgctccgacatgctgtcgcacccgccgcccggtcataaggtctataaagactctttttttttagaaacgaagaaattgctgaagcgtttgtaatgttttctggaaaaagagaatacggatatacagatatgatcaggtaaaagcgggggacatgagatggatgatatacaccggattttggatgtcatcgctaattctaagaaagctaaggtactggctaccatcattcaaacagaggggtccgcttataagaaagaaggggcttcgatgttgattttagaggataaaacaagagtcggaatgttatccgccggttgtctggaagaagatctcgttgaaagggcagaacaggtctggtctgcgggagaaccgttgattgtccgctttgatatgagtgcggaagacgatttatcctggggacagggcattggctgtaatggtgttttgacggtgttgcttgagcctgtaaaaggggaattggaacggcatctgatgacagtcaagacatgcttagatgaaaaaaagtctgtgacccgaatgaagcgattcactgaaacgttagagccgaaggaagatctgtatatcgctgaagacggcagcgtgtttggaaccggggatgtgatggaacaaggccgtattcaaaaactgagacagacggagaagggaatcaaaagggatgaacatacatctgatttgttttttatccatcagatggtgccaaaaccttgtttatatgtcttcggagcaggagaagatgcgaggccgttagtttcgttggcggctcgtgcgggctttcatgtgacggtgattgactggcgtcccgccttatgtcatcacggccattttcctgaagccggccatttgataacgggagcgcctgaagaagtcatgaaaggcctgagcatgacaaaaagggattttgttgtcattatgacgcacagctttcaaaaagatcagatcattttacatacattaaaaaacgagaatgtgttttataaaggcgtattaggcccagaaggcgtacggagcggcttttaggcgggggtgagattccggaagatatacattcccctatcggacttcccatcggggcacaaggccctgaagagattgctgtaagcattgtcggcgagatgattcaaaaaatgcgaaaacaaaggtctcgcctatgaaaacagcaggcatttacctggcagccggtacaagcagacgcatgggaacggataagcgaagtttatttctcaatggcgtttccctcggaagtatggctcttaaaaatgccttgttatctgaattagatcatatttttgttattacgagaaagggagattcactgcattggctttcggattttttctttttagatcccatgtcaaataagtggagccaggcagaatgtgagcaagcgggtaagggccaaggccattctatacaatgcggtttgcaaaaagcggcagcgtacgaggctgacgccgttatcattctccttgcagatcagccgtttgtcaccgcagatatcatcaatacgttaattgattcctatcaaaaagagcgccgttattcatttatcgccgctgaaaatcagcatcttcctatgccccccattttattctcaaatcaatgtttcccggtattgcatcagttaaagggagatcagggcgcccggcatgtgatccgtgaaagtatgatcaatatgggaaaaatgatcagctttcaagaccctttgcttttttatgacgtcgatacagttgaagattatacgctgctgctgaataaattcggggagtgaatgagttggagtatatcgggaagagtgtcattcggaaagaggcccttgaaaaagtgacgggtaaagcgaaatatacggatgattttcaagaaacagggacgttgcacgcaaaaatgctgaccagtccatatgctcatgccgatattgtgtcgatggacttttcagaagcttggaagattcccggcgtgagagcgatattgggggatgaaccttttccgcttgcaggtgaagaaattaaagacagatcgccgattgcttataaaagggtcagataccatggtgagccggttgctgttgttgttgcggaaaatccgattacagctaaaagggccgcggatgccatcaaagtatcctataaacctcttcccgtcgtcaattccccccgtgaggcctttcaaaaggatgcgccgctcgttcatgaacatgcggaccgctatgagaagacaaaaggtgtattcccggttccgaagacaaatatcgcaaacgtggataaggttagaaaaggaaatattgaagacggatttagggaaagtgatgtgacagcagaattccagatttcctttaacccttctgatcacgctgcgatggagacaagatgctcgatcgctgaaattcgggcggatgaggagattatcattaccacatcctctcaagccccttttgccattaaaaaattaatgcagtggtattttggaattgaacccggaaaggttatcgtcaaaacgcctttagtaggcggggcgtacgggggaaaagcagccgttcagttagaggtgattgcctatttggcatcaaaagcagtcggaggccggcccgtcaaattgtttaatacgagagaagaggatatgatcacatctcccgttcatgtaggattggatgccattgtcaaattaggggccacaaaggatggaattttaaaggcggcggacattcagcttttatttgatggcggagcatactctgataaaggagtggacatcagccgggctgcggtggttgattgtacgggtccgtacgctatcgaccatatatcgtgtgattcatattgtatgtatacgaatcatccatatccaagtgcattcagaggctacagccatgctgaagtgttatttgcttttgagcggacgatggatgtattggcggaaaagctgaacatggacccgttagaacttcgctataaaaatgccattcgccccggtgacaccacaccgactcaagttcttctcaattcaagcacggtcggaaatgtaccgaaatgtattgaaagattgaaggaattaatgaattgggacgagggacagcgaattgaaatcgacggccggaagatacgggcgaaggggatcagctgtatttggaaaacctcaacatttgatacaaatgcaacgtccggagtgattttaacctttaatcctgatggaagcattaatttgatgtcagggatagtggagattgggacagggacaaaaacagtgttagcccaaatcttagcggaacgaatgaaaatggatataagcaaaattcacgtaaaaatgcttgtagatacacaaacaacacccgagcattggaaaaccgtggggagcagagggacgttaatggccggaaaagccgtactgaatgcagcggaggaagccattcgaaagctgaaggacgcggcatcatgtgtgttgcgagttcctgtcgaggaattggaagtggccgacggaaaggtttattttatagatcatccttctgtacatgttgacataaaagacattgcttacggatatacgtttccgaatggaaataccattggcggccaaatcattgcgagcggcaattacacattaacccggatgacgaatttagaccgggaaacgggaagaggaaagccgggacccgaatgggctgtaggtgctcaggggattgaagttgagttggataaacgggattatacgtaccgaattacaaaagcctattctgttgtggatataggaacagtattgaatgaaaaagctgcaaggggtcaagtgatggggggatgagtatgggaatcgcattcggaggaagagaaacctttgtatttgattcatatggcagagtattaaatcctcagcttagaacataccgcccccttcactatggagagcagcctgaatatatcattgaatttgttgaaaccccgcatgtgattgcgccttatggagcgcgcggcggcggggaacacggactgctggggatgccggccgcattgggaaattgcctttccgccgctttaggtgtccaattgaatcaacttcctctcattcccgaacaattatggaggacgcaagaggggtggaaagatgataccgtttgattttgattattttaaaccgaagaccattcaagaaacaatcaatctatttcactcgcttgcggccgaaaagaaaacaccaatgtattattccggcggcacggaaattatcacgttaggaaggctgaatatcatctatacggatgcggtgatagacatgaacgcgcttccgggatttcaaaccatccgcttttatgaacatgaactggtgatcggagcgggtgtgtcattaacgaaactggaggaagaaaatccatttccgctattaagtaaaacagtaagtgaaatagccgatcggacgactcgaaataagatcagcctgggcggaaacatttgcgggggcatctactaccgtgaggccgtgctgccgttgctgatttctgatagtttgctagggattgcagggagagcggggattcattaccatcctataaataaagtatttaacaaggaaatacaattgcaaaaaggtgattttttatttcatatcgttgtcgatcgagcgtatgttgacttgccatttgtcagtatcaaaagaagacagcagtggaatgtcggatatccattggtgacagtctgtgcgctgaaaaaagatgatgagatcagaatggctttcagcggcgtatgtccatttccgtttcgttctgctgaaatggaggctgtgcttaacgataaaagctattcattagaagatagagcgcgcaggtctttacagtatgtacccaaacccgttcttgatgatgcggaaggctcaagtgaataccgaatatttgtcttgcaacatacaattttagatgccttacgggaattagaaggaggtccaaatgtctgatcctattacgttgaaagtaaatggcgaggaaagacagatgacggtcagaccggctgatactttgttatttgctcttcgtcttcgtctcggattaactggtgcaaagccgggctgcttaaatggggattgcggcgcctgtacggtattaacggacggggtgccgatgaaatcttgcttaatgcttgcggcagaaggggaaggaaaggatattacgacaattgaaggactgatcaatacgccgattcaaaaggcctttattgaaaaattcgcgtttcaatgcggttattgcacaccgggttttctcatgaattgtcatgctttagtgaatactgagccgaatgcaagtgatgacacgattaaaaattggctggagtccaatatttgcagatgtaccggttatcgggagattgaagaagcggttaaatccgttttacgtatagggaaagggactcattagtccgtaaccgtaaaaaaaagagcccagagaatcatctctgaactccatattcttcacttcatataccgatactcccgcagtttctccaaaatcgccacttctttcatcagttcttcaccgacgtttgtttcttttactttcttccgctccagctctttgtcgactaatcgtttcactgttaagacgtcggttccggtgctcagcacttcggccttggagttaaagtgtttatgggcgacgagctgcataccgtatgagttgtataagagcgtgtagccggcgatgcctgttgtggattggtaggctttggagaagccgccgtcgatgacgatcatttttccgtttgccttgatcggatcttcgccttcgatttcttttaccggtgtatggccgttgatgatatggccgtgatccggattgaggccgaattccttcaggatgtttcggcaggttgcctcgtcttcacgcaaatagtaatacgggtttttcttttctttatgcgtttccttctctttaatgaaataccgctcaaaggttgtcatggcccgttttccgaagagggaggagtattcgcctgtccataagtaccacgtcatatctgtcgccagatcatcggtttcttccggatgggcaaacgcttcccgtaagaaccgttcaaatacatcgagcagctcacggcccgcataagctttatcctctatcatcatcgtttccatgctgccgttttcatcgacgggaatacagccgtgaatcaacaggttgccgttatatttcagatacaggctgcctttttcatcataaaattcatatggcggcccagcttttcggagtgctggacagaaaacagcagcttgtccatgacttctgcttcttcttctagcagctcgtcaggctgtttgggattcaccgtcgcaaagcaggtgttttccagttgatacgtttttccgttcagcgtgatttcattgcggtcataatcgatcttttccagtaacagccgttcttccatattaaagttcggccgtctcttaataatcgggctctcaagcttgaattggatcatcgcgatcgcctgatgaatttttgtgatttgtttaatctcatcttccggtctgttttcgtccgctttcgggcggaaagacgggttatcatcgtaatatttttcggcaaggttcaatagcggtctcagattgatgccgtaaacgtcttcaataatatccagattgtcatagcgggcacagatgcggataatatttgccaggcatacttttgagccggaataagcgcctatccagagaacatcatgattcccccattgaatatccactgaatgatagttgatcagttcttccatgattttatccggctgcggtccgcggtcgtaaatatcgccgaccacatgcagatggtcgaccaccaatcgctgcgtgctgtaggcaagaccggtgatcagcttatcggcctggccgagcgcaatgatctgttctatgatttcggagtagtattgttccttgttggcggcttgttctgttttgtacagcagctcttcggaaatataagcaaattgggcgggcagtgctttgcgcaatttggatcgggtgtacttggaagaacaataagaaacgagcttaatcatccgatgaatcgtttctttataccactcgtttaatgcctctttcgtatcaaagccatgtttgatcagcttcagtttgtcttccgggtaatagaccaaagccgccaattcatcaatttctctatcgtaaatgacgccgttgaaaatatcgcggatcttctcttttactcttcctgaaccgttccgcagcacgtgctggaatgcctggtactccccgtgcagatcactgacgaaatgctcggttcctttcggcaggttcagtatcgctttcagattaatgatttccgtgaccactttttcttcacaatcgtatttttgtgcgagcagatctaaatatttggtttccaatctcgtccatcccctttttatttacgagcaattgtatgataaagtgaatttaaagtatgacataatgtttaaatgattagaccttatatgatagtaccgcataacgcctttttgagacaatgaaaacggaagatacggcgcttcaggcatcaaaaattggaccgggataacgctgtgagcgtatacccctgttgacaatgcattcaacttccattaaaataaaaagttagctgatagttatttctatcggaaactcaatacgtagcaggctatgattgctgtgggtcgcactacagcaggagcggcttctggagagaccgcgggttttccgcggcgccgaagggttcacaatctcaggcaaaaggacagaagagtaccgaatatgtatttgtcatgctgttgattgtcagcggcgcaaatataatttgatattcttatgaccatgagattggagggcatccaatctctttttttattggctttttttgctcgtcgttcactagagaggtaaggaggagtcagatgtggagcagcgagagctaaagagggacttatcgaatcggcacgtgcagctgatcgctattggcggcacgatcggtaccggattgtttttagggtccggtaaggcgattcagctggcgggtccttctatcatctttgcgtattttattgtaggtattgcgctttttttcgtcatgagggcgctgggagaactgctgttatctaaagcggggtaccaatcattaacggatatagccgaggcgtatttagggccgcgtgcagcgtttgtcaccggctggacttattggttttgctggattatgacggctatggcggatgtgatcgccgtcggtgtgtatgtgaaatattggtttgatattccgcagtggattccggcacttatctgtttgctcattttattagggcttaatctgttaacggttaagatttttggagaattggagttttggttcgccttaattaaggtagtcacgattctcgcgttaattgtcatcggggtggttctgctggtgattgggttcaaaacgcataccggaacggtttcagcggcgaatctgtgggagcacggcggcttgttcccgaacggattttcaggctttttgctttcatttcagatggtgatcttcgcctatgtcggtgtggaattagtgggtgtgtcggcggcggaaacgtcaaatccgaaaaaaaatattccgtccgcgatcaataaaattccattgcggattttatttttctacgtcggggcattgatcattcttttatgtattaacccgtggatgcagctgaatgcaacggaaagtccttttgtaaagaccttcagtctggtcggcattccgttagccgcgggaatcattaattttgtcgtattaacgtctgccgcttctgcttgtaacagcgggatgttttcaacaagccggattctgtataacttaagcaaaacgaaacaggcgccggcaagttttgcgaagctgaataaaaatcatgtgccgagccgcgcgttatggatatcggttattgtgctgtcagcgggcgctcttttaagcaaattgataccggaagcggcctttggcatcgtgacaaccatcagcgcgatctgtttcatttgggtgtggggcgtgattcttgtctgtcatatcagatacaggaaaacccgtccggacttacacgcaagctcgtctttcaaggcgccgtttgcgccgtttatcaattacgccgtgctggcgctgtttgccttcattctggtgattatgctgtttgcggatgcgacgcgcccggctttgctgctgacgccgctgtggtttattggattgtttcttatctatcgggcgagagggagaaagacagattgaattacttcagacggtgtactgccatgcagtatgccgttttaatataaaaaaagcgctatcctgccgtgtaagcagggtagcgctttttacattaattccggatcaaataatcaaatgcgcctaaagcggcagttgcacctgatcccatggagataatgatttggttgtacgggccgtctgtgcagtcccctgcggcaaataggccgggaacgcttgtcgcgccgctcttatcgacgatgatttcgccgatgcggttgcgttcgacggtttcgtctaaccattctgtattaggcacgagaccgatttggacgaatacaccttggagttcaacgtgtttttcttcgcctgtttcacggtcaacgaacgtaatgccgtttacgttttggtcgcctgtgatttctttcgtttgtgcatttttgtgcacagtgacgttcggcaggctgtaaagacgtttttgcaggacttcgtctgctttcagttcaggcgcgaactccagcacagtcacgtgattgacgatacctgcaaggtcaatcgccgcttcgattccggagtttccgccgccgataacggctacgtctttgccttcaaataatggtccgtcacagtgcgggcagtatgcaacacctttgtttttgaactcttgctcaccaggtacgttgacattgcgccagcgggcacctgttgaaaggatcactgttttacttttcagtacagcgccgttttcaagttcaagttcgaagaggtcttttttctcaaggcgtttcgcgcgctgaaggttcatgacgtcaatatcataatctttcacgtgctcttcaaggcttgcagcgagcttcggtccttcagtcgctttgacgctgatgaagttttcgatgctcatggtgtcgagtacctggccgccgaagcgttcagcgacgacaccggtgcggatgcctttacgcgccgtgtagatcgccgcgcttgcgccggcaggtccgccgccgacaacaagaacgtcaaacggctctttgtcggcaaactcagacgcatctgcgccgctgcccattttcgcgagaatctcttcgatggtcatacggccgctgccgaaagattcaccgtttaagaaaacagtcggaacagccatgatgtttttgctttctacttcttctttgaatgccgcgccgtcaatcattgtatgtgtgatattcgggttgagcacactcatcatgtttaatgcttggacgacatcagggcaattgtggcacgtcaggctgatataagactcaaagcggtattctccgctgatgttcttaatctggtcaatgaccttttgatcagccttaggcgctctgccgctgacttgaagcaatgccagcactaatgatgtaaattcgtggccgagaggaacaccggcgaatgtaacgcctgtgtcttctccggtacgattaacgctgaagctcggtgttctgtttaattcagttttttcaactgaaattttagatgacatggaagccagttcgtcaacgagagccagcatgtccttagaagtgtcatcgtcaccggcgcttactttgagaacaatgtcgttctcaattagctgcatgtattgatttaattgtgctttgatatttgcatcaagtaccaatggaatgcactccttagattttacctaccaaatcaaggctaggtgtaagtgtttcgccgccttcttcccatttagccgggcagacttcacctgggttttgacgaacgtattgagctgcttttactttgtttactaggttgcttgcgtcacggccgataccgcctgcattgatttcaactgtttggataacgccatcaggatcgatgatgaatgttccgcggtcagcaagaccagtttcttcgtcaagaacgtcgaagttgcgggagatcgtttgagatgggtcaccgatcattgcgtaagtgattttgccgattttttcagagctgtcatgccagcctttgtgtacgaagtgagtatctgtagaaacagagtatacttcaacacctaattctttcagtgcagcgtattgtccttgaagatcttcaagttcagtcgggcaaacgaaagagaaatccgctgggtagaagcagaaaacgctccattgacctttcaaatcttcgtttgttacatcgatgaattcaccgtttttgaaagcttttgcttcgaatggcagtacttcttttccgattaaagacataatatcttcctcctgaaatgtgatttgaaatatattaaaaagacaaagcattcactttatctttcaataataattctaattatatatagattattaaataacatttattttttgtcaagctatatggggtattattttctgctttttttgctttagacgttaaaaaacgcctggtataagcggtttggcgctgtttgtcatgtttagcgccgggcgaaagggggattctcaattggtgaatcgaaacagtaggaatcaacccctctatatggcagtataaaccaaagggggtatgatcatgcaaataaatcacattactttgtacagttgtgcgttggaggagacgaaacacttctatgaacgggtgttaggttttcctttaattgatgagtccggggattcgtttaccatcaaggcgggagaaagtgagttggaattcaggcgcgccgattctcactctcaaccgacgtatcattttgcgtttaacattccgaataatcgttttgatgaggcgaaggcgtggataaaggataaagtcgtttttcaaacggaagatggggaggatgaggtgtatttctcccatattcaggcgcgttccttttattttaaagatccgtccaacaatctggcggaattcatcgcgagagacacatcgccgccaagcgcggaacgtttttcgattgagtccgttctgaatatcggtgaggtgaatctgacggctgccgaggtggtatcgacggggaaggagctgcagcgtctcggcattccggtgagaaagcatgcgcctcttagtgaaaacgggtttcattttatgggtgattacaatgatggggcgtttttgcttttagggccgagcggccgccgctggattttttctgatcagcatgcggagttccatccgctgtctgtcattgtgaacgggacgatccgcattgaggctgacggagaaggcggcattgacatcaggcgggcacagccgtcataaaaaagcccgggctcaaaaggcccggacttggggacattatttataaacaacccgggtgctgcacatgatgtcgtgcagcgtttttttctctccgaaggcacccatgatgaatccgatataaagaatgagcttggatatgatataggcgaaagcgcgtccgaaggcctggccgatggaaatgcgtccgccatcttcattgacgaccttaaggccgagcaatgcttttcccagggtcccctgcatctttgaggctgtgagcaggctgaaatataagatgctgatcacaatagagctcacaagaatcggaatgacgccgaacaccagaaaagagatgttaaactgattttcggtcatgaaggggtcagccgccgcaacgcctgccgcaaataaaaaagagaccataaattgaatgataaaaatcggaattcctatgatgatttgatcaatgacgtaagccagaaaccgaatccaaaatcctgccggtctttccatgtatctttttctctcccttgctttaatctggaatattatacgtaatcattccggattttgcaatggagcttaagcttctgcgagcagcctctttccccatgccaagcgtcccatgatcagcccgaaagccagaagggcaaacatgatgccgcaccacatcagctgatggattcccaaatgtgaaataaaccagccgcccgccgccgttccgatggtgatgccgaggttggaaaaggagacaaacaggctgttgccgaattcgggcgcctcctttgcttccgcagtaagccatgtctggctgacaatgagaccgccggaatgaacggcgccccatacgaagacgaggacggccatcggcgcgaaagacgtcccaaacccgtatatgagcaagtaggcggctgtataaagaagcggaaacaggatgacggtctttttcatatttttatataacaaagcaccgaagacgaaattcccggctatcataatcaccccgaaactcatcagcatgaagctgacccatgtgccgatcatatgggacacccgcccgaggtactccgcaaaatagctgtagacagaaaacatggccgcaaagagacaggtgacggcagcgatattgagccacaaagccggtttgcgaagaatgccgagctggcttctgaaagacattttttctgtgaccggcatggatggcaaaaagagaagaatgcccgtgaacgcgatgagactgatgatagcgccgaataagaaggcggcttcaagagagagacgatccgccagataagacgtgaaaggcacgccgaacgcaaagccggcggtgatgcctgaaaagactttcgttacggcttttccggattggccggcggggacaagccgggccgcggccgcaagcgctacagaaaagaacaccgggtggcataaagccggaatgatccgaaacgccagcatgacactgaaatgcgccgtatacgcgtagaccgcatttgaaacggcaaacatcagcaccgctaaaagcagaatgtatttccggtttatacctgaagcaagcaaggtcaaaaacggtcccgacacagcgacgatgaacgcgaaaatactgacaagccaccccgcttttgaagcagaaatatgaaatctgtccgccacttgcggaagaacgccgataatgcccatctcggtcgtgataatcccgaaaacccctagtgccaaaaatagaatgaagatggagctgctttttttcattgttatgtatgcctccttttatttaactacatatatagaaaaatagatatgttagaacaaaaaaatccctcctttcatggttatagctggtgctggacatagtcagcaaaggctttaatttgtttttcatttcttctgtaataggtccactttccgattcgttcggattccagcaggccggctttttgcatcgtcagcaggtagctggagatgacggactgcgcaagccctgactttgcctgaatatcaccgacgcaaattccggtgcggaaactgagtccctgatcaagataaggtctttcatcaaaatggtcttccgggtgtttaagccacgtcataatatcacttcgtgttttgttagataacgctttatgaatcaatatcggttccataacgtttattatatctatttttctggatttgtaaattcgtttttgacaaaacattctcaaattaagtaaatatcgtgctaaaatataacatattatcagattaccggtaaaaaagccgggttattgtcaggaggatattcacatgaatcaaaagaaaaaaggtgcggttgcggtgaccttgctttccgctctgatgttttgtttattgccggtcctcgtctcgctttctccgcttgcagaaacggggccgaacgcgaatcgttttaattccgcgggcatgtgggccgccgtcggtcagatccttgttatatatgcggtcccgctcattatgtatattctcggtgttcgtggcatgaaaatcatcatggctgttttttgcgggatcgggcttatcatttgcgcggctgtcttgttggtggcgttattgaccgcaatttccttagggcaggagctgtctctttattacggtcttttcgtttggtcaggcgcggctttcatcgtcaatgtggtgtggtatattgccgcgtttcgatcatccccgaagcatcagcaggctatgtgacatttgttctataaatctaccgaaaatacaaatatttcataggatgattatggtatgatgaaagcggtatagcagtttttaatagaaacgggaggaactgacattgaaaaaaaagacagcttcattgcgaatgaaaacattggcggccggcgctgcggttgctgcggctttatctgtgggggcggtttctgatctgccgggggcaaaatggctgcatccggcggctgctcaagccgcggaaacggtatttaaacaaaatcatgcggcatccggtttcttggcgggacggtatgacgcgcaggcgatgtctccgacgatgttcaactggtcaagggaaagccggtttacaagcactgccgatggcgcgttaaaatgggaaaagaatgttccggccacccctcaaaacggtgcgggagccgcggttgacggggacggcacagtatttattcaatcaaaagacgggaagctgacggcgtatcatccggacggtactgtgaaatgggtgacggaaaacctcgggacgacctatacgctgactccggtgctcggaacaaacggtgtcatttatcttccttctcacgataaaaaactgtatttcatcgacaaagaaaccggaaacattttaacatcggttccgctgagcggagcgccgagttccgatgcggctatcggctctgacggcacgctgtatgtgtcgacgctggataactatatctatgcgattaaaccgacgtcgccatcgacatggacgcaaaagtggaaatttaaaacaaacggcgtggtcggctccgctcccgtgttagcatcaaacggcactctgtatacggcaacgtacaataatatcttttacgcgatcaattccggaacgggccaagtgaaatggtcaaaaacgacgtccaacgggtttaaaggttatccggttattgatagagacggcaccgtttacgccggaaaccaggacggcaacttatacgcctatacatcaacgggtgctgtaaagtggacgttcccgttaaacggtttctccagctcttcattagcgatcgaccataacggcaatgtgtatatcggttcgggaagcggcgagctgttttccatcagcaaaaccggtaatatgaactggtctttctatacggacgggcctgtgagaacggcgccgctgattgatgcggacggcaatgtgtacttcggttctgacgataaaaacgtctatgcggttgacgctgaggggaatgaaaaatggcgctatcaaacagacagcaatgtcatttcctccccggttctggctgaagacggcacgctctacgtcggcacttatacgaaactgctcgcattcggggcaaaaaaataataaaaaagaatccgcgcacgcggattcttttttttatttagaggcttgaatgaatacgcctttttcatgagagaattctttaaaaccgtacacaccgtgatatgaaccgatcccgctcgtattgacaccgccgaacggaaggttgacgtcagtgaaatgaacgacgacatcattgacagaagcattgccggacgtcgtatgctgcagaacataatcgatcagctcctgattatggctgaatacatacaaggcaagcggcttgtcccgttcagtgatgtaatcaacggcttcactgatatcttcgtaattcataatcggcagaatcggtgcgaagatttcttcctgcatgatcttcatatcaggcgtgacgtttgtcagcacggtcggagaaatcgtgcggtcatgagcatcgaatacgccgccgaacgccgtttttgcccctttttcaatggcatcatcatacagggctttgacacggttaaagttgcggtcattgacaatctgcgtgaatttgttgcggtcaaccgtatgatcatcctccataaaacctgcattgacaatggtctgcaggagatctgtaaaggtgtcctgtacatcttccttcataaggagatagtcaggggcgatacatgtttgccccgcattgacaaatttgccgacggcgatttttttcgccgcgtccatcaaatcatagccgctgtcgatgatcgtcgggctctttccgccaagctcaagcgtgacggacgacaaatgcttcgccgctgccgtcatgacgattttaccgacattcgtgcttccggtgaagaaaatgtggtcaaacggctggtcgagcagttctgtcgcgacatcgacctcaccttcaaaaatggcgacttcttcttcgtgaaatgcctcgcgaataactgtcgcggcgatatggctcgtctccatcgtaaaatcggacagcttcacaatcgcgctgtttcccgccgcaatggcagccgcaagcggagccatcgtcagcataaacggataattccatgggccgagaattaaggtaaggccttttggctcgtacattaatacgccgtcagcgtcggggctgacggatgagccgacgcgtttcggcgccatccaggtgtcgagattgttcatattatctttaatcgccttgatcgttccctgcgtttccgctcttttcacctcatgataaggcttgcggacgtcccgtctgatcgcctcgatgatttcttcttcatgtgcggtgacggcatctaaaaagcgctgaagcttttctctgcgctgcccggctgttgaagcacgcagcgttttttgattttttttctgaagcgcaaagacgcgtttgatgtctgcttttatatgctgatccatcggttttcctcctctggttgcttttttatttcttcagggcctattataatgtgatgtgtttttgcggcaaagacagcgtaaacgcatctatacgttaccgtacaaattgccgtgatctgtctaatgaaaggagtgtctcttatgccggattctatgacaaatgacatcaaacaagcgcttttggccatgcttggagagcgggatatccgccgtgtgaccatgaaggacatcgccgaacgggcgcacgtgagccgggggacactgtacctttattacgaagataaatatgcgattttagaggatatagaggaagaaatgaaagacgggctgagcgaagcgctgtatgattcgctgaagaataaagatgtgcttcatttacagggcggatggcaaaaagtgcatccgacactgtcttttgttgaccggcaccgggtgttttttcaaacgatgatggaccgtcataaaatgccgtattttcacgttcatgcttttttaaaagatgtgttccggcatgatgtgctgctgtcaccggtcaatgcggatttctcaccgactgaacaggatatgtacattcattaccgcgcgttatacacatatgccattgtgttgtactggctgaatgaggagcccggggcatccccggaagaaatcagcggacaggtgtgggatttgatttctcaaaaacggttttactggctgtttggccgccgggtgccggaacaagaagaaaaaaagcccgccgaccgccgggtgacaaggacgaggcaggccttgcaagaagccatgatcggcttaatggcggaaacaaaagagtacgcggcgatcacgatttccgatattgcccgtcaaagcaacctccgccgtgccactttttatgaccattacgccaacaaagaagcattgctgaaaacgatcatccatcaatcatgccgggatctgatcggattattgacggtaaaaggagatcctgccgactgttccgtggaagaagcggaagccgcgctcgtccggctcttttcggcgctgtccggcggccttccgctcgttcattttctgagagagggttcaggagtgcctgacgtcatcccggaaatgttcagagcgctgcaatcgttttatcttcatcagcctctgcacattcaggcgggcaaaaagctctatgcatactatgtcgcgtccatgctcgtcggtctgattcaatatcgtcttcatgaaggaaaagaccacgcgccggatatgctggcccgggagtttctgcagtttttggatgtgaagaagtatcgggtgattttgctgtgaggatgatgaaaaagaactcggccgaaaacaggccgggttcttttttgctgttttctttgagaagtgcagatatgaaagaaaccttccatatgacgcctgattagcattctgccgccaaacatgacaaatgtcatattcggggcatgatggctgctactacaaccgcgtcgggcgccccgttatacttgaggtcataatgaaaaagaagggacatgacattcatgatcaatcacgccgcaactcaaaaacaagcgtctttaaaaaagcaggttgccgcattttccggcgccgatacaaagcatagtatcattcagcttttcaacacgtttgtgccgttttttgccctttggtttcttgcttacttcagcctcaatgtctcctatcttctgaccctcgcctgtactgttatagcagcgggatttttgacaagaatctttattattttccacgactgctgccaccaatcctttttcaaacaaaagaagctgaaccggctgttcgggtttatttcaggtgtgctgacactgtttccgttccttcaatggcagcgaagccactccattcatcatgcgacaagcagcaacttagataaacggggcaccggcgatatttggatgatgaccgtcaaggaatataacgaagcgtcagcctggacaaaaatacgctacagactttatcgcaatccgtttattatgtttattctcggcccgatttacgtatttctgattaaaaaccgtttcaatgtaaaaggcgcccgccgcaaggagcgctggaacacctatttcacgaacgcggcgattgtcttattggctgctgcgacgtgcttgcttctcggctgggaaaactttttgcttgttcagggtccgattttccttatttcggggtcaatcggcgtctggctcttttatgttcagcacacgtttgaggattcttattttgaagccgatgagcattgggattatgtgcaggccgcggtagaaggaagctccttttacaagctgccgaagcttttgcaatggctgacgggcaatatcggctatcatcatgtccaccacttaagtccgaaggtgccgaactacaagctggaagccgctcatgagggacacgagcctttaaaaaacgtaccgaccattacgcttaaaacaagtcttgaatccatgaaattccgtctgtgggatgaggacgaaaagcagtttgtcaccttccgggaggcgcggaaaacatcggcgccccatccggtgccgaaagaacctttaaagaaaaatgcctgatacggcgcacggctctttctcttatcagaaagagccttctcttcatgcgtgagggtgcaatgaaggcggtgttttgataaagtgatggtagacacaagcagcagaaggtggaacaaagatgaagaagtattttaaatttcaaaaactgaacgggatttctccttatatatggacgatttttttcatcctgcctttttattttatttttaaaagctcttctaccttcgtcatcgtggccggcatcattttcacgctcgttttctttggcgcataccgctttgcatttgttgcaaaaggctggccgctttacttatgggcgcttcttctgatcggcatttcgaccggctcagccatgctgttcagttatatttatttcgccttctttattgcctacttcatcggccatatccgagacaaagttccattttacatcttatattacattcatatcatcagtgcggcggttgccgtcaacttcagccttgttctgaaaaaagaatggtttttgacacaaattccgtttatcgtcattacactgatcagtgccatcctgcttccgctcagcattcgaagcagaaaggcacgggagcgccttgaggagaaattagaatatgcaaatgagcgaattgccgatcttgtgaagctggaagaaaggcagcgcatcgcccgggaccttcacgatacacttggacaaaagctctccttaatcggactgaaaagcgaccttgcccgaaagctgatatataaggaccctgaacaggcccgcgctgagctgaaaagcgtgcagcagacggcccgcacttccttaaatgaggtcagacaaatcgtctcatcgatgaaaggcatccgattgaaggatgagctcggcaatgttcggcaaattcttgaagcggcaggaattgaatttgtgtatgaagaaaaagaagcgcccaaacatatctctttgctgaacgaaaacatcgtcagcatgtgcattaaagaagccgtcaccaatgtcgtgaaacacagcggcgccaaagtatgccgcatcaccattcagcagctttggaaagaggttgtcattacggtagaagatgacggaagctttcaatgcagagaagaccgctttttttcaaaggggcacggcctgcttggaatgagggaacgtcttgaattcgcaaacggcagtttagccatcgatacagccgccggaacaaagctgaccatgagaatcccgaatgattcaaaatcaaaagaaaaggatggtagcagatgatcaacatcttcattgccgaggatcagcaaatgctgctcggcgcactcggttcgctgttgaatttagaagaggatatgacggttgtcggcaaaggcacaagcggccaggatgccatcgatttcgtggaaaaacatgcgcccgacatctgtctgatggatatcgaaatgcccgggaaatcaggtcttgaagcggcagaagaactcaaggacagcggtgtgaaaatcatcattttgacgacctttgcccgctccggctattttcagcgggcgctaaaagcaggcgtcagcgggtacatgctcaaggacagcccgagcgatgagctcgtcagcgccatccgcagcgtcatgaaagggagacgcgtctatgcacctgaattaatggaggacatttatagtgaagaaaacccgctgaccgaacgggaaaaagaggtgctcgagcttgtcgcagacggaaaaaacacgaaagaaatcgcaaacgccctcagcatcaaaagcggcacagtccgcaattacgtttcgatgattctggataaactagaagtgaaaaatcgaattgaagccattacccgatcaaaggaaaagggctggtttaagtaacccgccctcagcttgttcagccagtgttttttttacactggctttttttattatctatcgtcactccgtctcttccttccacttcttatcaatcagcattttccccggccaagtgtatgccatgatgccgccgtctgcggtgatgtcttctcccgtgacgtaagagctgtcgtctgaagcgaggaagagcgcgacagccgccatttcttccggttttccgagccggccgagcggcgtgatccatttgttggcttcacggaacgcctcgcccatttcgtcttctttcgtgcctgccaatttatcaatgagcggcgtttcaattgtacccggcgataaggaattgacgcggattccgcttctggcgtaatcaatggccatcgctctcgtcaggttcgtgattccgccttttgcggcgttatagccggaacggtcaaggtctgcggcccggccggacatggaggaggtgttgatgatggagcctcctttttcgagcatgagcggaatcaggtatttgctgcacagaaatgtgccgcgcagatcgacggcgatgatccggtcaaacaggtcgaccgggtattcatggacattgccgccctcttggtcaacaccggcattgttaaacagaatatcaattgttccgtacttttgctgaatgccgtctgcaaaagactttacgttttcttcatctgatacatcaaggtgaaaggcttctgcttctccgccgttttttctgatggcgctgacggtttcattcagttcgctttcattgatgtcaccgcagatcacgcgggcgccttcatcggcgaaaacccgtgccgtcgcttgtccgatgcctgtcgcggcccctgtgatgattgcggttttgtctgttaatcttcccatattgcgattcctcctttttctatacctgttcccgctgaatagggggataaacatacggaggtttgtttctaattacctattaaatatgttaatattatgtatatacatcattgggaggtttacatattttgaagatacagcataagaaggagatagcgttttattgttatgccattgttcctatgggatttgtgatctacaccgttatctctattctgtttcaggacatcacgtttcctctcactgtaagaaatgttctgcatgagtctttgcgaaacttgggatctcttatcttatttagtttgtttttctacccgtcatacatatggatgaagaaggaattcggccgccggaaagaagcagagaggagaggatgatcaacattctctcttttttattgataaaatgggtgaaatgaatccattaacatgttaaatttacaatatatgcatctgctaatcctagttgacaattgtcactgtatatgataaatagatgctgaaaagattttacataacatcaaagcataattaaaggagagatctgaagtgcggaaaaaaaagtttaaagcagaatccaagcgattgctggacatgatgattaactccatttacacgcagaaggaaatttttctccgcgagttaatttccaacgcgagcgatgcgattgacaaaatctattacaaggcgttaaccgatgattcattaacgtttgatcaagacaattactatataaaagtgacggcggacaaagaagcgagaacgcttaccgtcacagataccggtatcgggatgacaaaagacgagcttgaacagaatctcggcacgattgcgaaaagcggttcactcgctttcaagcaagaaaatgactcgaaagacggccatgacattatcggccagttcggcgtcgggttttatgcggcgtttatggtggctgataaagtcacggtgaaaagtaaggcgctcggcagtgacgaggcgtatgtatgggagtcggaaggggccgccggctacacgatcgcgccgtgtgacaaggaaaccgtcggtacggaaatcaccctgaaaataaaagaaaacacagaagatgaaagctatgatgagtttttagaaaactaccgcatcaaagcgatcgtgaaaaagtactctgattttatccgctacccgatcaaaatggaagagacggtcaacaagccgaaagagggcagcgagaacgaatttgaagaagttcaggaagaacagacggtcaacagcatggttccgatctggagaaaaaacaaaagcgagctgacggatgaggattacgaggctttttacgccgagaagcattacggttttgataaaccgctgacccacgtgcatatcagcgtcgatggagcggtgcgctacaattcgattttgtttattccggaaaacatgccgtttgactattatacgaaggaattcgaaaaaggattggagctgtattccaacggcgtgctgatcatgaacaaatgcgccgacctgcttccggatcatttcagctttgtaaaaggcatggtggattctgaggatctgtcgctgaacatttccagagagatgctgcagcacgaccgccagctgaagctgattgcgaaaaacatcaataaaaaaatcaaagccgagctgaagagcttgctgaagaacaaaagggaaaaatacgaatctttctatgaatctttcggcagacagctgaaattcggcgtctataatgatttcggcgcgaataaagacgtcttaaaagatctgcttctcttctattcatctaaggagaaaaagctcgtcactctggacgaatatgtgtccagaatgcctgaggatcaaaaatatatctattacgcgtccggcgattcatatgagcggattgaaaagctgccgcaaactgaaatggtggcggacaaaggctacgaaattttatatttcacggaagatattgatgaattcgcgatcaaaatgctgacaagctacgaggaaaaagagttcaaatccgtctcaagcgccgacttaggcatcgacagtgacgaagatgataagcagactgaagccgaagaaaacgaatataaagacctgttcgaaagcatgaaagagattcttgcggataaagtcaagaatgtcagagcctcaaaacgcttaaaatctcatccggtctgctttgcgacagacggcgaagtgacgatcgaaatggagaaagtgttaaacgccatgcctgacagccagcaggtcaaagcggaaaaagtgctggaaatcaacccgaatcacgaagtgtttgagacgttaaagaacgcgcacggacaagatcgggaaaagcttgctttatacacaaacctgctgtacaatcaggcgcttctgattgaagggctgccgatccatgatccggtcgagtttacgaatgatatctgcaaagtcatggtatgacgccaaaaaggaatcgcccagcggggcgattccttttttgattacagtgtgcgctgtttaagaatttgattttgtttgctgcgcttctttaaggagaaccgttttttcaagtgcgtttcgatttcttctaaacttttgcccttcgtttcaggaacgatgtaagcggcaaagaagaaggatgtaaggcagatgactgagaatattccgaacacccagccgatgcccattgcgctcagcataagcggaaataccagcgaaacgatcaggttggttgccgacagaatcaatgtcgtaaatccggttgcggctccgcgtgcgtttgacgggaacagctccggcatcagaacccatacgacgggaccccatgtcgcctgataaaagacgatatagattccgagaaacagcacggtcagccaagctgttgaagctgacaggccggccagaaggagaatggctgatagtgacgccaggctcaaggtaatgccgacacttccccacatcagcagttttttccggccgatccggtcaattaagatcatggcggtgatacacatgatgacgtttaagacaccgatgcccatcgtgccgagaacggacgccgaagtgccgagtccggcctttgtaaagatggtcggcgcatagtaaatcaccgtgttgataccgaccgcctgctggaagatggcgaggccgatcccgatcagcagcataggacggatccattttgctttcagcaagccgagcgtagattcttttttctcggcttctccttgtttcatttccgccaattcaacggcgatatcctctttgtcgtgagtcatttccatgacttgtctggcttcctgctcacggccgcgtttgacgagccatctcggagattccggcataaacgcgattccgattaataaaagcgccgccggtactgccgcgagaccgaccatccagcgccaagcttcaaacggggtgaatatgtaattcacaatatatgcgagtaaaattccggttacaatcattaagttattcaatgtgccgagcgttccgcgtatttttgtcggcgccatctcagatagataaacgggaaccagcgccgttgagcctccgacggctaacccgagtatgacacgggagataatcagcatggtgacggtttgcgaagccgcacaggcaagcgcgccgataataaaaatgagtgaaaggacgaaaaccacttttctccggccccatcggtcagagcatgtcccgcttaaggcggacccgaaaatcgcaccgagcagcagcatgctgacgaccaatccctcggtcagcgtgtttaaaggaatatcattgttaataaataacaaagcccctgaaatcacaccggtgtcatagccgtaaagcagcccgcccaatgctccgaaaaagtaaatcaggtattttttggtgtttttcttcacagatgatcctcctcatcttttggaacgcataatagtttatttagataactatttcattccccgaagagaaaaatataaacataaaaaaacacgccctttcaaaaaggcgtgttatttttcttaggaaaacagcttgtcaataaacgcgatttcttcagcagatagcgtaatggaggctgctttcatgttgtcttttaattgatccgcgcgtttggcgcccggaatcaggatatcgatttcaggtctcgccaagtaccaggcaagcacgatatgcgccgtatcggcattgtgcttttcagcaatcggtttgagctggttgacttttttgatgttttctttaaactgctccccttggaaatgcgcctgatcattgcgcaggtcgccttccgggaaggttgtgttctcgtcgtatttgccggccagcagtccggatacgagcgggaagtacggaatgaatgagatgccgtgttctgtcgtataagggaagaaagtcttttccgcctcacggttcagcaggttgtattctccttgaatcacgtcgactaagccgtctttattagcttctttcagctgctccaaagagaaattggatacgccgatggaacggatttttccttcttttttcagctcattcaatgcttgaacggcttcgtccttcggtgtatgctcatccgggaaatggatgtagaataaatcgatgtaatccgtctgcagccgtttcaggctgtcttcaaccgattgtttcaaaaaggccggtgagttgtcgaaaacaaagtcattgccttcttttctatgagcggcttttgtggcgatgaagacatcctcgcggttatattctttcagcacctcgccgatcaattcttcagaacggcccacaccgtaaatataggcggtatctaacatggtaacgccgcttttaatcgcttcccggaccaattcttttcccgtttcttcattcagattcggatagagattgtgtccgccgaccgcatttgttcccaaaccgatcggaaatacctttaggtcagttttgccgattgttactttgctcatgttttcgccccctgaaaaaattggatatcatagcgcctgccgggaaaatacggcagcgttctctattaactataacgctatgccaagtgaatgtcgatttggtgctcttggcaatacttcgtatattcctcatcgagctgctgagaagtgacgatgctgtgaagccggtcaaaaggcgcgtatgtcaaaagcgtggatttgccgaatttggaatgatccgcgagcagatacacttcgttcgccttttcggaaattttctttttcacctcgtattccagtaagtcggaattcgtcaggccgtgggtgatcgttgtcccggtagcggacatgaacgccttgttaatgttgtatttattgagtgtgcccggatcatcaatgccgacaaacgaccttgtcttccgtttgtagttattgccgatgatgatcaggtcgatatttttcatggatgaagcggcgttaataatatcaaggctgttcgtcaacaccgttacattcttatccgggtcaagcgtctccagcatcgatttggtcgtcgtgccggaatcaataaatacaagatcgtgatcctcgataaaccgcgacgcatagcgggcgattttgattttttcatcctgatgttgaatggtgcggttctcaaaagggacgagcacagatttttctgctgacgtcacgccgccgtacacctttttgatcacccctttttccgcaagcttattaatatcgcgtctgaccgtgtttttagagacgttgaatacctcgcacagctcatccagcgaagtggctccgtgtttgagaatgtattcttccatctcctgaatccgcatcagtttcataaaaaaactccttctagaattcttaaagtaattaaaatatataataaacaccaagagttaatcaatagttacttaacaaatgataaaaaagagggttcccaccgtacgattcgacacggttctccaagttcctgttttcccgcttaaaaaaagtatgataaaaataatgaaaaaattttgattttttagattgacttgaaggtgtgttgggcttacaatgtaaccaagaaatgaccaaaatataacctgtaaaatcaaaagtgaaagatgtaaccgtttgctttatccggcacatgaccaacttttacatgaaaagattgggagtcaccatcattttagcatttgtaagcgtttaattcatgtcttttatatgtaaaagatgaatatattcatccgttattatccagctgaacaggatgtttactatttaaggaggcaatgagaatggcagagatcagaaaactgaaaaactacatcaatggtgaatgggttgaaagtaagacagatcaatatgaagacgttgtcaatccggctacaaaagaagtgatgtgccaggttccgatttctacgcgggaggatgtggaatacgccgtccgctcagcgtcagaagcgtttaaaacatggtcgaagacggcagtgccgcgccgtgcgagaattctatttaactatcagcagcttctccagcagaacaaagaagagcttgcccgtctgatcactttggaaaacggtaaaaacacgacagaagcactcggtgaagtgggacgcggaattgaaaacgtcgaattcgcagcaggcgcgccgtcactcatgatgggcgattcacttgcctctatcgccacagatgtagaggcggcgaattaccgctatccgatcggggtggtcggcggcatcgcaccgttcaacttcccgatgatggtcccgtgctggatgtttccgatggcgatttcgttaggaaacactttcattctgaagccttctgagcgcacgccgctgttaacggaaaaactggcagagctgtttgaacaggccggtctgccgaagggcgtcttcaatgtcgtgcacggcgcgcatgacgtcgtaaacggcattcttgagcatccggagattaaagccatctcattcgtcggttcaaaacctgtcggcgagtatgttttcaaaaaaggcagcgaacatttgaaacgcgtgcaggcgttaacgggcgcgaaaaaccatacgatcgtgttaaatgacgcccaccttgaagatacggtcacaaacattatcggcgcggcattcggttcggcaggagagcgctgcatggcatgcgcggttgtgacggttgaagagggaatcgccgatgagtttatggcgaaattacaggaaaaggccgcagacatcaagatcggaaacggactggatgacggcgtgttcttgggcccggtcatccgcgaggacaacaaaaaccgcacgcacagctatattgaaaaaggcatcgaagaaggagcgaaactgctttgtgacggccgtgaacatgtaacggaagacggctatttcgtcggaccgacgatttttgacaacgtgacgacggatatgacgatctggaaagatgagatctttgcgcctgttctgtcggtcatgcgtgtgaaaaatttaaaagaagcggttgacatcgccaaccagtctgaatttgcgaacggcgcctgcctgttcacgtcaaatgcgaacgcgatccgctacttccgtgagaatattgacgcgggaatgctcgggatcaaccttggcgtcccggcgccgatggcattcttcccgttctcgggctggaagtcttctttcttcggcacattgcacgcaaacggaaaagacagcgtcgacttctatacacgtaaaaaagtcgtgacggcacgatacccgtctcctgacttcaattgatcagacagccggcccggacggctttgtgattccgtccgggttttcttttaccatccattaaggaggaataaacatgagtcatttgctgcgcaaaccgcaggccgatgaaatttctcaaggcgtgaccatcatacatgacgtcacttcagccaattcagacctcaaatacgtcggatttaaagtcgttgatctcgctcccggctcaacctatacagaagatttgaaaaagacggagtgctgcatcgttgcggtaactggaaaagttaccgtcactgattatgatcagacatttgaaagcatcggcacccgtgaaagcgtatttgatagaaaaccgacggacagcgtttatgtgtccaatgaccgctcttttggaatcacagccgtcagcggggcgagggtcgcgctgtgctactctccgtccgaacaccagcttccgacaaagctgattaaagcggaagacaacggtgtggaacatcgcggcaagctggcaaacaaacgaaccgttcataacattctccccgattcagatccatcggcaaacagccttctcgttgttgaagtttacacggacagcggcaactggtcgagctacccgcctcataaacatgaccaagacaatctgccggctgaatcatttttagaagaaacctattaccatgaaacggacccgccgcagggatttgtcttccagcgtgtgtacacggacgaccgctcgattgacgagacgatgaccgcagaaaatgaaaacgttgtcatcgtgccggcgggctatcacccggttggtgttccggacgggtatacctcttactacatgaatgtaatggcgggaccgacacgaaaatggaagtttcataatgatccggcccatgaatggattctggaacgctgacaagtgaggagtggcagataacgatgaaatatacgtttaatgaagaaaaagagtttgatattgtcgcgatcggacgcgcgtgtattgatttgaacgcggcggaatacaaccggccgatggaagaaacgatgacgttttctaaatatgtcggcggctccccggcaaatattgcgatcggcagcgctaagctcggattaaaagccggttttatcggcaaaatcccggatgaccagcacggcagatttatcgtttcttatatgcaggaaaagggcgtcgatacgtcacaaatgaccgttgacagagaaggacgcaaagccgggctcgcttttacggaaattctcagtcctgaagagtgcagcattctgatgtaccgggatgacgtggcggatttgtatctagagccgtccgaagtcaatgaaggctacatcgcaaacgcgaaaatgctgctcgtatcaggtacggcgcttgcgaaaagcccgtcgcgcgaagccgtcttaaaagcggtgcaaatcgcaaaaaaacatgacgtaaaagtcgtgtttgagctcgactaccgtccgtatacatggcaatcggcagaagaaacagccgtgtactacacgctggcggcggaacaatccgatatcgtcatcggtacgcgtgacgaatttgacgtaatggaaaaccgcagcggcggaaataacgatgaaaccgtccgccatttgtttgcgcactccgccgaccttgtcgtcattaagcacggcgttgacggatcatacgcatacagcagatcgggagaagttttccgggcgcacgcctataaaacaaaggtgctgaagaccttcggagcgggtgattcctatgcgtcagctttcatctacggactggtcagcggccgggatattgaaacgtcgttaaaatacgggagcgcttccgcttccatcgtcgtcagcaaacacagctcctcagaagcaatgccggctgccggtgaaatcatcgaactgattgaagcgcagcacagtcttaacggtaaatagaacgtataaaaggtgggatcgtttgtgggtaagacaattcgcttaacgacagcacaagcgctgattcaattcttgaaccggcagtacattcatgttgacggaaaagaagagccgttcgttgagggcatcttcacgattttcggccatggaaatgtgttggggatcgggcaggcgctcgagcaggacgccgggcacctgaaagtctatcaaggcaaaaacgaacaaggcatggcgcatgccgcgatggcatacagcaagcagatgctgagaagaaaaatttacgcggtatcgacatcggtcggtccgggtgccgctaacttgacggctgccgcgggtacggcgctggccaatcatatcccggtgctgctgcttccggccgatacctttgcgacgaggcagcctgacccggtgcttcagcaggtggagcaggaatacagcgccgccgtcacgacaaacgatgcgttaaagcccgtgtcccgctattgggaccgcatcacccgccccgagcagctgatgagcagcttaatccgggcatttgaagtgatgacagatccggcaaaagcgggcccggcgaccatctgcatttctcaggatgtagagggagaagcatttgattttgatgaaagcttctttgaaaaacgtgttcattacattgatcggatgcagccgagcgagcgtgagctgaaaggcgccgcggagagaattaaggagagcagccgtcccgtcattttagtgggcggcggcgcgaagtactccggcgcgcgtgaggaattaatcgcgctttctgaaacatacggcattccgcttgtcgaaacgcaggccggcaagtcaacggttgaagccgattttgccaacaatctgggcggcatgggcatcacgggcacacttgccgcaaacaaagccgcccgccaggctgatctgatcatcggtgtcggcacacggtacacggactttgcgacatcctcgaaaacggcgtttgattttgacaaagcaaaatttttgaatatcaatgtcagccgcatgcaggcatacaaacttgacgcgtttcaggtcgtagccgatgcgaaagtgacgctcggcaggctgcacggcttattagacggatataaaagtgcattcggcacggcgattaaaggctggaaagatgaatggctggctgaacgggaccggctcggcaaggtcacttttacacgtgacgcgttcaagccggaaattaaaaaccatttctcacaggacgtgttaaacgagtatgccgacgcgctcgagactgagctgccgcaaacaacggcgctgttgaccatcaacgacacgattcctgaagacagcgtcgtcatcagttcggcgggatctcttccgggcgatctgcagcggctgtggcattccaacgtcccgaatacgtaccatctggagtacggctattcctgcatgggatatgaagtatcgggcacgctcggcctcaagctggctcatcccgacaaagaagtctattcactcgtcggcgacggaagctttctgatgctgcactcagagctgattaccgcgcttcaatataacaaaaaaatcaatgtcctgctctttgacaactccgggttcggctgtatcaacaacctgcagatggatcacgggagcggcagttatttctgcgagttccgcacagaggacaatcagattttaaacgttgattacgcgaaggtggcagagggctacggcgctaaaacatacagagccaatacggttgaagaactgaaagcggcgcttgaagatgcgaaaacgcaagaggtatccactttaattgaaatgaaggttctgccgaaaacgatgacggacggctatgacagctggtggcatgtcggcgtggcggaagtgtctgagcaggaaagcgttcagcgggcatacgaagcgaaagagatgaagctgaagtctgcgaagcagtactagaggggaggcatcacgatgggcaaacaaaatattttgtggggcatcgctcccattgggtggcgcaatgacgatatgccggagatcggagccgggaatacgctgcagcatttgttaagcgatattgttgtcgccggttttcaaggtacggaagtgggagggtttttccctgaaccctccgtcctcaataaggagctggctctccggaacttgcggattgcggggaaatggttcagcagctttatcattcaagacggtattgaaaaaacggctgaacaatttacagaacactgtgattatttgcagaaagtcggagcggatgccgccatcgtttctgaacagacgtacagtgtccagggcttggatattgatgtatttaagaaaaaaccgcacttctcaaatgaagaatgggatacactgtgccaaggcttgaaccgtctcgggaaaatcgctgacgaatacgggctggagctcacgtttcatcatcatctcggcacaggcgtccagacggcggaagaagttgaccggctgatggatggaacggacccgcggtatgtccatttactttatgataccggccatgcctatatctcagacggagactatatgacgattctcaacaagcatatggatcggatcagacacgttcatttcaaggacgcgcggtttgacattatggagcggtgcagacaggaaggcaagtcattcaggcagtcgtttttacagggcatttttacggtgcccggagacggatgcatcgattttaccgaagtgtaccaaacgctcgtccgtcatgattattcaggctggatcgtcattgaagccgaacaagacccggcagtcgccaatccgcttgagtacgcgctgattgcgagaaagtacatcgacagtgaactgcttgatcctgcaaattagagggggacttatatgaatagtgccaaggcggaatcagctttcagcaaacggaccatcgccgcagcattagcaaattacattgatgcaggttccatcgtggcaggatcagcgggtttatctatgtgggtcagctacttgaagctgtccgacagtcagatcggattgctcggcgccttcagcgcaaacgcgatatcagcggccatcggagcgctgctcggcgggtatttggctgataaggtcggccgaaaagctgtatacacaaacagtatgctcgtctacgctttaggaatttgtttggttttgtttggattcaactttcccatgctgttatgcggatacatgattatcgggatttctgtaggcgcggatattacggcttcatggaccattatcgcggaaaacgcccccgagaaaaaccgggcgaggcattgcggagtggcgcaggtggcgtgggccgccggagccgttgtggttctgctgttatccgttttggtcggtgacctcgggcttttaggaaataaaattgtctttgcgcatctattggtgatcgccctgatcacatatgtgataagaaagcgtttacctgagtcggatgcctggaaaaacagtgaagagcggcctgccgccgtgaaaaaaacatcttattttgacttgcttcagccgaaatttttcaagaacattttgtttttaatgggtgtgtttctcgtatggaatctcgccgcgggcgtcatgggattcttcatgccgtacatctaccagcaggtcggcggcgtatccgcaaatacggccaacattctgcagatggccctgtttatcttcaccgggctcggcgtcgcctgtatcttcatgccttttgcagatcaatatcggaaaacggtgttcggaatctgcgcctttatggctgttgtcggctggtcgctgtttttgctgccgtttcagggactcccgatgctgcttttgtttgttttagcgatcggcatcaataacggagccggccagcaggcgaactaccagctgtgggcaagcgagctgttcccgacagaacacagagcgtcagcacaagggctcatgttctttctcgtccgtatttcaatcggcatttggagtttatttgtgccggtcatcatgtcacaattcggcatcggttttatggccggtattctgctcatatgtgtgacggccagtatgatcatcgggcttgtcttcgcaccgaatacgtccggcaagtcgcttgaacagatacaggaggaactgtacggtgctcctcaggacggcagagagaaaagaaagacgagaaccattatttgattatcagaaggagtggcgatcaatgaatttacgtataggtgttatcggaaccggtgctatcggaaaagagcacatcaaccgcatcacaaataagctgtcgggcgcggaaattaccgctgtcacagatgtgaatcaggaggccgcgcagcagaccgttcagcatttcaatttgaacgcctcggtttatcctgatgacgacagccttctcgctgctgaaaatgtggatgccgtcttagtgacaagctggggcccggctcacgaatccagcgtgttgaaagcgattcagcacggcaagcacgtgttttgtgaaaagccgcttgcgacaacggcagaaggctgtatgcgcattgtcgaggaagaaatgaagacgggaaaacgattggtgcaggtaggtttcatgcgcagatatgacagcggttacgttcagctgaaagaagcgatcgacaaccgtgcggtcggcgagccgctgatgattcactgtgcgcaccgcaacccgacagtcgcatcgaattattcaacggacatggccgtcgtcgatacgctcgttcatgaaattgatgtcctccactggcttgtcaatgacgactatgaatccgtacaagtcatctatccgaagaaatcaaaaaatgcgctgccgcatctgaaagatccgcagatggtcatcatcgaaacaaaaggcggcatcgtcatcaatgcagaaatctatgtgaactgtaaatacggctatgacattcaatgtgaaatcgtcggggaagacggcgtcattaagcttccggaaccgtcaagcatcagcttgagaaaagaaggaaaattcagcaccgatattctgatggactggcagcgccgatttgcggctgcgtatgatgtggaaattcaggacttcattgattcgatccggaagaaaggcgaagtcagcggtccgacggcatgggacggttatattgccgcggtgacaacagacgcgtgcgtaaaagctcaggaatccggacagaaagagccagtggcgcttcaagagaaaccggcattctatcaatcatttacgactgtgaacaaataatagatcgggagtgaaaaaatgaaactggccttagatccatccatgtaccgcgatgatttaacattagaggaaatggtctataaaacggcggaactcggatacgaatatatcgaactgtccccgcgcgaggatttttgtcctttctataaatatccgaaagtcgattcagcaaaaatcaaacaattgaagcgccttttaaaggatacaggtgtgaagctgtcctcccttcttccgctttaccactgggcgggtcctgatgaagaccgccgccaggccgccgtgcgcaactggaaacgggcgatcgaaattgcggttgaacttgaagtggatttgatgaacagtgaattcagcggttcaaagtatgatccgttgacaagtgaagaaaaattcatcaaatccatggatgagctgctgcccgtctttgaaaaagaaggcgttaaactcaatcttcaagcccatccatacgattttatcgaaacgcacaaaggtgcgatggatatgatccgcgcgctcgataaggattggatcaatcttgtctactcgactgcgcatacgttcttctatgatgacggcaaaggcgatatcgaaaccatgtttgatgaagccggcgaccgcctcacacatgttttatttgcagatacttttaatcataaagcggcgcacggcctgcgttacatcgtcaatccgcctgatgcgaaagtaacggttcaccagcatctggacatcgggcaaggcgaggtcgattttgagacgattttcagaaagatgagagagatgaaattcgacggaattgcgacgaacgccgtgtttgcttgggtcggcgaaagagcggatgaatcaagccggaccacgcttaagaaattaaaggaagaactgggtatggcataagctgagtatggagttcggcggagcggggcaaaaaagcccttcagccggactcccttcatatcgaaaacgcggatgggagaggctgacatgaaactttgctttaatgaagcgactacgctggagaattcaaacctgaaacaggatttagaactgtgcgaaaagcacggctatgattatattgaaatccgcacaatggataagctgccggaatacttaaaagaccattcactggccgatctggcggaatattttcatacccatcatattaaaccgcttgccctgaacgccctggttttcttcaacaatcgtgatgagaagggttatagggagatcatttcggaattcaaaaaaatgatggaaacctgcaggacgctcggcgtgaaatatgtggtggccgtgccgcttgtgacagagcggaaaatcttgaaagaagaaatcaaaaagagcagcatagaggtgctgactgagctttcggacatcgcggagccgtacggcgtaaacattgcccttgaatttgtcggccacccgcaatgcacggtcaatacatttgaacaggcgtatgacatcgtgaacgctgtcggccgcgataatgtcggactggtgtttgacagcttccatttccacgcgatgggctccaatattgagagcttgaagcaggcggacggaaagaaaattttcatctatcatatcgacgatacagaagactttccgatcggctttttaacggatgaagaccgcgtctggcctgggcagggtgcgattgacttagacgcccatctgtcagcgttaaaagaaatcggattcaatgatgttgtctccgtagagctgttcagacctgaatattataagctgactgcggaggaaacgatcaaaacggcaaaggaaacaacggaagccgtcgtatcaaaatacttcatgaaggaggcgtgaacatggcttttgtcaccatgaaacatcttcttgcagaagcgaaacgggagcattatgcagtcggccaatttaatatcaacggcctccaatggacgaaggcgattctgcaagcggcgcaaaaggagcaatcgccggtcatcgccgcggcttccgatcgtctggtcggctatttaggcggatttaaaacgatttccgccatggtcggcgcgttaatggaagaaatggcgattaccgttcccgtcgtgctccatcttgatcacggaagcagtgcggaacgctgcagacaggccattgacgccggattcagctcagtgatgattgacggctcccatcagccgattgacgagaatatcgcgatgacaaaagaagtcaccgattatgccgcaaagcacggcgtctcagtagaagccgaagtcggcacggtcggcggcatggaagacggacttgtcggcggggtctgttatgccgatatcatggaatgtgaacggatcgtgaaagaaaccaatatcgacgcgctggcggccgccctcggctccgtccacggcaaatatcagggcgagccgaatctcggatttaaagaaatggcggctatctcccgcatgactgatattcccctcgttctccacggagcatccgggattcctcaggatcagatcaaaaaagccatcacgctcggccacgcgaaaatcaatatcaacacggaatgtatggtagcctggacagacgaaacacgccgcatgtttcaggaaaacggcgatctgtacgaaccgcgcggctacatgacacccggccttgaagccgtggaagagacggtgcgaagcaaaatgagagagttcggatcagccggtaaagccgtaaaacagcagatcggctgatgaaaacggaaaccgccaagatggcggtttttttgtgcggtgttgcgtccgtacgcccgaaacgattatgatgatggcagcagtgtaagaaacgggagtggttcagtttgaataaaatcatgattgtggaagatagtgaagacattcgcggactattgcagaattaccttgaaaaatacggatatcaaaccgtggccgccgcggatttcacggctgttcttgatgtctttttgcgggaaaagcctgatgtggtgctgcttgatatcaacctgccgtcttatgacggctattattggtgccgccagatccgccagcattctacaagcccgatcattttcatctcagccagaagcggggaaatggatcaggtgatggcgattgaaaacggcggagatgattatatcgaaaaaccgttttcttatgatattgtgctggcgaaaatcaaaagccagatccgcagggcatacggagagtacgccgccaagcagggagagaaagtggttgaatatgccggtgtgcagctctttgtggaacggtttgaactgcgctttcaggacgaaaaaagcgagctttctaaaaaagaaagcaagcttttggaagtgctgctggagcggggagaaaaggtgacgggaagagaccggctcatggaaaaaacgtgggacaccgacattttcgtcgatgataatacgcttaacgtgtatatcacgcggctcagaaaaaaactgcgggagctgaacgcgcctgtttccattgaatcggtgcggggcgaaggctaccagctgagggcgctgtcatgaagctgtttctccggtctcatgccgtgctgattctgctttttctccttcaagggctgtttgtcttcttttattactggtttgcgggtcttcattctttttcccacctgttttacatattgggcgtgcagcttcttattttggcggggtatcttgcctatcgctggtacaaagaccgcggtgtgtatcattggctcagctcggagcaggaagggacggacatcccgtatctcggttcttcagtgttctgttcagagctgtatgaaaagcagatggagctgacccggctgcagcaccagaagctctacgagaccgaagccaagctcgacgcgcgggtgacgtatatgaatcaatgggtgcaccaagtaaaaacgccgctgtcggtcattaatttaatcattcaggaagaggatgagcccgtctttgaacaaatcaaaaaagaggtccggcagattgaattcgggctggagacgctcctttattcatcaaggcttgacctgtttgagcgggattttaaagtcgaagcggtttccttatcagagcttctccaatcggtcattcaaagctataaacgattttttattcaataccgcgtctatccgaaaatggatattcgcgatgatcatcagatttacaccgatgccaaatggctcaaatttgcgatcggccaagtcgtcacaaatgcggtcaaatattcggcaggcaagagtgacagactggagctgaatgtcttccgcgatgaagacaggacgatgcttgaagtcaaagattacggtgtcggcattccctcgcaagatatcaagcgggtgtttgacccttattacaccggcgaaaacgggcggcgtttccaagaatctacgggaatcggcctccatctcgtcaaagaaattacgggcaagctcaatcatacggtggacatcagctcgtcccccggtgaagggacatcggtccgattttcatttcttacaaaaatgtaagactgcgttaagaaaacaacatagctcattctgtttccccttgataacatggatttacgtcaaggggatttttatgctgaatgccccggcactacatgaaagcagcccagatcaacaagaataaaaccataaggaggattctcatggcgaatatgcttgaagtcaaacatataaataaaacctataaaggacaagtatcctatcaagctttaaaacaaatttcattttcaatagaagaaggcgggttcacggcggtgatgggaccgtccggctccggaaaaacaacacttttgaatatcatttcaacgatcgaccggccggattcaggcgatatcctgattcacggagaaaacccgcaccggctgaagcggacaaagctcgctcatttccgccgcaagcagctcggatttgtgtttcaggatttcaatcttctggacacgctgacaatcggtgaaaatatcatgctgccgttaacgcttgaaaaagaagcgccgtctgtcatggaagaaaaactgcacggcatcgcgaaaaagctcggaatcgaggacctgctcaataaacggacgtttgaagtatccggcggacagcgccagcgggccgccatcgcaagagcggtcattcataagccgtcacttattctggccgatgaaccgacgggaaaccttgattccaaagcgtcaaaagatgtcatggaaacgatgcagagcctgaatcaggatgatcatgtcacggctttgatggtgacccacgatccggttgcggcaagctactgccgccgcgtcatctttataaaagacggcgaactgtttaatgagatttaccgcggggaaaaccgccaagtcttttatgagcagattcttgatgtgctgtctatgctggggggaaacgcaaatgacctttcttcagttcgcttataaaaacgtcacgagaaacaaaagggcctatcttgcattcttcttgagcagcgccttttccgttttgattttctttacctttgcgatgttcctgtttcatccggcactaaaggaaggctacctgaataacatcgccaaaaaaggcttaaccgccgcggaatggatgatctttgttttttctttcttatttgttctgtattcggttaacgcatttttgaaatcgagaaataaagaattcggtattctgctgatgcagggtattacgccggtgcagctgagaaagctcattacggcggaaaacatgatcatcggcgtcatgtcgatcgcagcggggattatcggaggcttcattttttcgaaaacgttctttacggtcggcgcttatattttagaaatggacgcgctgcctctgtacatgccttggaaagcgctcggcattacggccggcggatttctgctcttatttttccttttatcgcagttcacgatcctttttgtcagatcaaatacggtgatcaaattaataaagggcactgacaagatcaagccggagccgaagccgtccgtgcttctgtccttattcggcatcgcctgcctgtgcggcgggtacggcatggttctgaaaggcaatgtccacgggaccgagccgttcatcattttactgcttaccgtcatcggcacgtatttctttttcagccaaagcagcatctggattctgcgcgcgctgaagaagtggaaaaccttttatctgcgcgggaaaaatgttatttgggtttctgaccttgtctatcgtttaaaagacaacgcccgcctgttctttatcgtcagtattatttccgcggttgcctttacggcgacgggcgtgctcgcgatgtacaaatcgaccgtcggggcggaagagtccgcctatgagatggagtatttatctttcagcaataacccgaaagaacagactcatttgaaagatattgaccatgaactgaaaacacacggctttacgtataagaaagacaaaatagatgtttcctatgttcgctatcaggaaggagaaactgttccccctgtttatatgatcagcgaatcggatgtatcaacatacttccatgttaagctgaacggcctgaaacataatgaggctgtctatttcccgggcacgtatgaccgcaatttcaaaaacgacgcgccggatcagctgaagctgctgaaccaaaaaggcaagccgtctgaccaaaaactgacggtaaaagaagtcaaaaaaccgctgatttcattgaatgccatcatcgcggtgaacgatcaaacctttgatcagctgaaatcactcggtgagaaagcgtcattatacggctacagctatgatcattggaaagacagtcttgggatcagccaatccttgaaaaatgagatttacggcaactatatcgacgtgcattctgattttatggcaaaagccgggacgtactatgatacggtgcagctgccgagcctgagtttattcatcggcctgtttatcgcgatcgttttctttgtcgcggcagcgagtttcttatatttcaggctgttcaccgatttagatgaggaccgggagcgctaccgctcattggccaaaatcggtctgagtgagcgtgaaatggcacaaagcgtgacgatacaattggcgattctctttttctttcctttcgtcattgccgtcatgcatacgctgtttgctttgagaacattagcggtggaaggctattccgatgtagcggggccgctcagtctgaccatcggagggtttttcatctttcagcttctgttcttcctagcggtgcggacaagctatttgaaaaaaatgaacaagtaaggggagtgcacagatgaaaaaagcattggcaatcctggccgtcttagcagccgctgccgtcatatacggacttctcttttttcataatgatgttacagacagatttaatccgtttattcaccagcaagatgtttatgtacagattgatcgagatggcaaacatcttagcccgggcggtactgagtatacattagacggatataacgcatccgggaaaaaagaagaagtgacctttttcgccgggaaagaccttcggaagaacgcgtatttgaaggtgaaggcgaaaggaaagtatgtcgagacctgggaagaagtcagatttgaagatatgccgggctccgtacagtcaaaattaaagtgaacatgaaaaacggcacagtgtcatgactgtgccgctttttttattttttattttttattttcttcagcccgtttgatcagcatgtcggtgatgatatccatctgtttgctgacggcaatcgggtcatacggatagaaggtgttgaaatcgttgataaagacacggttgttctttacggcatcgagatttttccaaacggatgactctttcagacgctcaaatgttttgctttctccattcggattgtaatcggtaatgaacatataatcagccgcatattgagggatgacctcttgggaaacctgtttcatggcgcccgttttcatgatgtctttttcgattttggccggcgctttcaatccgagtgcgttataaacggcttggccgccgcggccggaattgtcattaaaaatccagatttcgcctttatccgtcgtttcataaaggccgactgtctcgtctttgccgatcacgtttttgaggcgcttttgatcggcttcagcctttttgttgaagtctgccataaagcttttggctttatccttcgccccggcaatgtcgccgaataggctgaccgtatctttcgtattctttgcggtgttaaaaggaatgacaatcgtcggtgcgattttcgatagtttctcgtattggtcatccttcatcagcacgattaaatcaggcttcagctgcatcactttctccacattgacgggattgccgatgtccgtggtgtttttcagctgttttttgataaacggatttttgaaagcccatgagcccgccccgacgacatttgcgtcaacggacagcagctcacccgcataaaagtcagtgacgatccgttttggatgtgcgggtatgtcaatatttccttttgttgattcatatgtacgcatgtctgtctttcctttgcctgatgccgatccgttgttttccttcgcgccgctgcaagcgcttaatgcgaaaacaagcagaagtgccaggccgatcagccatgattgtttcttcataatgatccccctatttcggtgataatgattatcattattaatatagcaggaagacgtcattccgtctatgttttttatagaaaaccttccttgattatccatgttatagtagtaaaggaggaggaatgaatgttgattacgaaaagagggacttggtgggaagtgctgcacagctggtggctgctgctgactttcgcgccgtttgggctgaccgctttcttggcctttttctatatcggctaccgggccaagaacaaaaaatggctgaaatacggacttatctattttattattttagcaattgcttttgtgctgccgagcacgccgggcgtgtatatcgtgctgcctttatgggtcatctccatcatccacgggctgaaagtgcgggcggcttatttaatacagcttgatgtgtttaaacaaaacgtcgaagcaagagcgtttgaagcggtaaggcatgaggcggaggaaaaattcggcggaaaacccgctcaacgcattgatctgacaaaacagagataaaaacaaatgacaaagccggtatctcgcgctttgtcatttgcatgaccggcctattgctggtatgaatgctgctgaaacggtgtgtgtgatgctgtgtttgcgggaatgaagaaacattagcgtttgccatcggtgcaggcatgtgtccgcttacttcctgctgaagctgattgcacacattcacgatttgctggcatttctgaatggccagttcatgcccctgcagcgcttgctgaatggtatgaacggcatgctgttcatggttaagcatctgctgaagcatttgaatgttttgctgttcctgctggagcatttgcttgtactgctgactgctttgctgtgtctgctgaataagctgctgtgctgtttgacggcattgctgcagctgatttccgctgtattggttttgatacatcatgaagacctcctgaagtgattgattttacacatttatcatgtgaaagaataggagaggcattcatgcaagaaaaggattcaaatatttacctgttatgtacagagcggaatacaaggctcgggatggcctgtcgagctttgtattccggccctttttctcagaagccgccttctgtagcgtgaaaaggaatattgagtctgttttcgactgcgcgcaggcgctgattcaaacggtttaagcggcgggtatggatttcaatggactggctcagccgtctgatctgctcattcatacgcgtgatttcccggttttggcgctggtcttcttgtgagaggcgggtgagctctctcgtttgctgggcgttttgtctttcaagctgggcgactctccgttctaaagccgtcggctgccgctcttcagactgagggggcgcataataatagctttcctgctgctgatacggctcatactcaacggggctcacttcgtattcctgctgctgagggaaataggcagatggggtgtagtactgatatgggttcattcatcattctccttatctagtgaagtctttatacactatgtagtcaattgcacagtgccacggcatccgcctaacttacaggcgtaaaaagagcttcaaaggaaggtgatcatgttgcggaacatacggattttcatcatgacggttcttgttatcggatgcgtcatgataacaggctgctcgcaaaagaaagcagacgaaccccctttttattacgggacatgggatgcggggctgaaaccgggcccgatggacggggtcagatctgaaaccgttacgtttacgaaagacagcgtgctgacaaagcaggtcattaaaggccgcggcgaggttcccatgccctcagatgcttacaaggtggtctcacaaaacacggacgggacgatcgagattgaatacctcggacatccgcaccccgtcaaaagcacgttgaaaagaggaaaaaacgatacgctcatttggaagatatacggagaaacaaaaacaatgacaagaataaaaaccggcggggaggatgcacatgagaaataaggctgccgacagactcgttttgacgggtgtcatcgtacatatcattcaatggttttcactgttatggttattttttatgctttttgatcagttcgggcgttttaccatttataatcccaatgtcgtcaacggcagcatgcagtctttttcattctttgatatgatgcgcgctcttctgttttccggcacgctgcggaatacgctcctgctgtttctgtttgcggcgatgctcatttacttgtgggtgaacgctctgtttatcctgctggaaatcgtttcttatatcatgatcaggcggaacagccgttcattatgggcatactttcccgcagcgatgggaataaagcttgcccttctggacatagcggccgtccctttctttgcggcggggctgatgctcttgaagcagaaaacagatgacagcggcgaacaagctgacaaggggaaaagacggccccgcatccggaggcaggcccggtataggaagagaaggcggagaaacttgtccgtttgatttttcattgaaacgaaaaaacgatatgatgaaagcataagcagaaaaggatacaaaggagatgcaggatgtacaagttaatcgcaatagatatggacggaacactattaaacgatcatcatgaagtgacggctgaagtccgcggggcgcttgatgccgccaaagcggaaggggtcaatatcgtcctgtgcacgggccggccgatcggcggcgtgcgtcggtatttggaagagctgaacttacaggaagaaggagactttgtgattgcctataacggcgcactcgtccaaaatacgtatacaaacggtgtcgtggccgagcagtcattaggctttgaagatttggagtcgctttacgagctgagcttacagttggatactccgatgcattactttgacacagccaatctgtacacgccgaaccgggatatcagtgaatacacggtatacgaatcatacattacgaaagtgccgcttcatttccgcacgatcgatgaagtgccgaaggatattctgattccgaaagtcatgttcattgacgatccggacaagctggagaaagcgatcgcttctattccggaatcattcagggaaacatacacaatggtcaaaagcgcgccattcttccatgagattcttcacccgaaagtcagtaaaggaaacgcggtcaagctgctggccgaaaaactcggcattgaacagaaagacgtcatggcaatcggcgataacggcaacgacatgtccatgattcagtgggccggctgcggtgtggcaatggccaatgccatcccggaagtaagggagattgctgattatgaaacgaaatcaaataacgaacacggcgtggcgcacgcgattcaggagcttgtgctgaaaaaataggcaccccatcagagggtgcttttttaccgcgtgttttggtgatatgataagcggagaggggaggcgcgacatggatcgtgaaaaacagcagctcagcatagaagcggcaaaactatattatcaatcagattacagccagcagcagatcgccgaacggcttaatctgtcacgccccaccgtttcaaggctgcttcagtacgcaaaggaaaaagggtatgtgcaaattcgcgtcatggacccgtttgaggatctggatgaactcggcgcgaagctggaagaaaaatacgggctgcttgaggcgcacgtcgtcttttctccaagcgacgattaccaggccattacacattacttaagccgctatggcgcagactatatgcataaaaccgtaaaggacggcgatatactcggcgtaagctgggggacgacgatgtaccagatcgcaagccgcatggagccgaagcaggtaaagagcgttgaagtcgtgcagctgaaaggcggcatcagtcattccaatgtcaatacgtattcgtcagaaacgattcagctgttcgccgaagcatttcagaccatgccgaggtatttgccgctgccggttatatttgacagcgccgatgtgaaacagatggtcgagcgggacagacatattaagcggatcattgaaatgggcagacaagccaatatcgccctgtttacggtcggaaccgtccgggatgaggcgctgcttttcagactcggctatttccgggaagaagagaaacaattgctgaaagcacgcggagtcggcgatatttgttcgcgcttttttgacgaggaaggcaggatttgcagcagcagcattaacggcaggacgatcggagttgagctcagcgacctgaaattgaaagagcgttcgattctggtggcgggcggcagcagaaaatgcaaggccattcacggtgccctgaaaggaaagtacgccaacgttttgattactgatcagcatacggccaaaaaactcattcaagaattgtgacaattcatgaacataatttcaattaccaatttacatatgttcaaaattcggttattctaaacgtatcctaggaaaaaggaagtgcatacaatgtcaattgcaagtcaaatagaccatactgctttgaaaccgcatacacaaaaagcggatattttacaactgataaaagaagcaaaagaatataaattcgcttccgtttgtgtgaacccgacttgggtcaaactcgcagcggaggaactgaaaggcacgggagttgacgtttgcaccgttatcggatttcctctcggcgcaacgacatcggaaacaaaagcatttgaaacgaaggatgccatctcaaaaggagccactgaggttgacatggtcatcaatatcggcgcattaaaagacggcgatgatggagcggttgaagctgatatccgcgcggtagttgaagcagctgataaaaaagcgctcgtcaaagtgatcatcgaaacatgccttttgacagatgaagaaaaagagcgtgcgtgccgcttggcggtatccgcaggcgctgatttcgtcaaaacgtctaccggtttttctacaggcggggcaacggctgaagatatcgctctcatgagaaaaacagtcggaccggacatcggggtcaaagcatcaggcggcatcagaacaaaagctgatgttgacagcatgatcgctgcgggcgcgagccggatcggcgcaagtgcgggcgtctctatcgtgagcggcggagacagcggcagcagcgactattaatcagcattgcggaagccgaaagcttccgccatcctctttctttgttgatgcataaaaaattgtaagcgaatacaaataaaaggagaacacatatgaagtatctcatcggaattatcggaatcattgtgtttttaggtcttgcctggcttgccagcaacggcaaaaaaagaatcagaatccggccgatcgccgtcatgctcgtgctgcagctgattctcggttatattctcctcaacaccggtatcgggaattttcttgtcggcggttttgcaaaaggatttaactacttgctggaatatgcatcagaagggattaactttgtattcggcgggcttgtgaatgcgaaacagacgacgttcttcatgagcgtgcttctgccgatcgtctttatatccgctttaatcggaattctgcagcattggaaggtccttcccttcatcacgaagtatatcggtcttgcgttaagcaaggtgaacggaatggggaaaatcgaatcttacaacgctgtcgcatccgcgattttagggcaatcagaagtctttatcagtttgaaaaaacagctcggctatcttactgaacagcgcttatacacgctttgcgcgtccgcaatgtcgacggtctcaatgtcgatcgtcggttcttacatgatgatgctgaagcctgaatacgtcgtgacggcgcttgtgctgaacttattcggcggatttatcatcgcttctatcatcaacccgtacaccgtcagcaaagaagaggatttgatcttcgttcctgaagaagaaaagcaatccttttttgaagtgctcggtgagtatataatggatggattcagagtcgccgtcgtcgtagcggcaatgctgatcggatttgtcgcactcattgccctggtcaacggcgtttttaacgcggtcttcggcattacattccaggcgctgctcggatatgtattcgcgccgtttgcgtttttaaccggtattccgtggaatgaagcggtgagcgccggaagcattatggcgacgaaaatggtatcgaatgaatttgtggcgatgcagacgctctcatccggcgatttccatttcagcgcgcatacacaggcagtggtatctgtattccttgtctcattcgcgaatttctcctctatcggaatcattaccggtgcggtgaaagggctgcatgaaaaacaaggaaacgtcgtcgcgcggttcgggctgaagctgctgtacggcgcaacgctcgtcagtttcctgacagcggcgatcgtcggattgattcactgaacataaatgaaggacaggtgatagatcatgagaatggtagatcttattgtaaaaaaacaaaatggaaaagaactgacaacagaagaaattcaatttttcgtaaaaggatacacggacggaagcatccctgattaccaggcaagcgcgctggctatggcgatttactttcaggatatgacggatcaggagcgcgccgatctgacaatggcgatggtcaattcaggggaaacgattgacctctccgccattgaaggcattaaggtcgacaagcactctacgggcggggttggcgacacgacaactctcgtactcgctccgctcgtcgcggcgctcggcgttcccgtcgctaaaatgtccggccgcggccttgggcatacggggggaaccattgataagctggaagcgatcgaaggcttccacgtggaattgtcaaaagatgaattcatcaagcttgtgaaccgcgacaaggtagccgtcatcggacaaagcggcaatttgacccctgccgataaaaagctgtatgcgctgcgtgatgtaacgggtacggtgaattccatcccgctgatcgcaagctcaattatgagtaaaaaaatcgccgccggagcagatgccatcgtgcttgacgtcaaaacgggagccggcgcgtttatgaaaacggatgaagacgccgtgaacctcgccaaagcaatggttcgcatcggaaacaacgtcggccgccagacgatggccgtgatttctgacatgtcgcagccgctcggttttgcgatcgggaatgctctggaagtgcaagaagccattgatacgttaagaggggaagggcctgaagacttaaacgaactcgtcctcacgctcggcagccaaatggtcgtattggcgaaaaaagctgagacattggaagaagcgagaacgaagcttcaggaagtcatgaaaaacggcaaagcgcttgaaaagttcaaagagttcctgagcaatcagggaggagacgcttctgtcgttgacgatccgtccaaacttccgcaggcggcgtacaaaattgacgttccggcaaaagaagcgggtgtcgtttcagaaatcgtcgctgacgaaatcggcgtcgcagcgatgctgttaggcgcgggacgtgcgacaaaagaggacgaaatcgaccttgccgtcggtattatgctccgcaaaaaagtcggtgacaacgtcgaaaaaggtgagccgctcgtcaccctttacgccaaccgcgaaaacgttgacgacgtgaccgccaaagtctatgacaacatccgcatctcagaaaaagcggaagcgccgaaactgattcatacgctgattacggaataagacaaaaaaggcacatacctcatcagtatgtgcctttttttttatggcatggttttatccaaatgaatgtcacggacggattgtttcggctgtttctttctcaaaaaacgaatgagatagcacaggatcatacaaggaattccgcagaagagggcgattctttgattgggatcaaatgcaaggcctacgcatgaagcgaaacataagatcacagcggcgatcggaacgagagggtataacggcgtgcggaaggtcagatccgcgacgcgtccgccgtttttcacataatgttttcgaaataacagctgagacagggcgatgctcatccacaccacgacgccggcaaatccggctattgccacgagcaccacgtagaccgtgcccggggcggcgatgcttgagatcaaggatatgcaggaaacggccatgctggcgagcagagcattcagcggaatgcctttcggcgtgacttttttgaaccgggcgctgatcatgttttcattcgcaagagaccacagcatccgggtggaagcatacagtccggagttggcgaccgaaagcaaagccgttaaaatcacgaagttcatgatatctgcggcgtatgggataccgatctgggaaaagaccgcgacaaacggactttcaatcacaccggcttccttccaggagatcagtccggacagcacaaaaatggcgccgataaaaaagatgaccgttctccaggcgacatttcggatcgaacgcggaatatcttttgccggattggcggtttcacccgctgtaattccgatcagctccgtccctgaaaaggcgaagcttacggaaatcattgcgatgaaaaccgcaagaaagccgttcggaaacagtccgccgtgtgaggtgaaattcgacagcatcggagcttcacccgaaccgtgcaatgaaatcaaaccgaacatcgcggcgccgcctaagatgataaataaaaggatggtgacgattttgacgctggaaaaccaaaactctgtttctgcaaacaatttaacggagaatgcattggcggcaaaaaggagagccgcgaaaatcgcgctccacatccagacgctgctgtggggaaaccagcgctgcatgaggataccggaagctgtaaactccgatcctaccgtcaccacccaattcacccaatacatgataccgaccataaaacccgtggacggcccgataaacgttgtcgcatacgtttgaaatgaaccggtcacaggcatggctactgacaattctccgagacactgcatgacaagatacatcatcaagccgccgatcaggtaagcggcgatcgtcccgcccggcccggcctggctcaatgtataccctgtgctcaaaaacagccccgtgccgatgacccctcccaatgaaatcataaataagtgcctgcttttcatcgtgcgctttagttgattgccgccttgatcaacatccatcgtgatctccccctttttgcgtggcatgagaatcttccggcagccgagatcacgcgtgccggatttgactttaacgtgacaatttaaatcccttcaatgcatgtaaaatgacgtgtgcggctgcccggcttgtcatatcgcgaaaatcaagtgtcggatcaacctcaacgatctcaatacccgagatgtcagcctcctgggctaaaaaccggaccgcctgaagcagttcctcggtatacaggcctccggggccgatcgcaggacagccgggcgcatgagcttgatccagcacatccatatcaaccgaaataaaaatggcgtcggctcttttttgaacggccggcaaagtgtcttgtatcgttcggagaagccctttctcccggatcatctccattgtatgcacgtctgcctgacgctcttttacatatttttcatatgccaggctgttgctgaactccctgattccaagctgaatcaggttttgtccgcttatgatattttcatctaacagacggcggaatggcgtgccgtttgtcggccctccgtcttctgtgttgcggacgtcgtggtgggcgtcgaattgaaagacggccgttgttcctttcgtttccgcaatggctttaatggtggaataactgatggagttgtcgccgccgagaatgacgggcacccagtcaggctggtccgtcagaatatcataaatggtccgataaatgtgttcgtgagatttgacgacatccgtgacgtgaatctgaatatcgccgatatcgtacagatggtcaatgacatgctcccgcagctccgcggaatatgcggaaatgccgccgagcgcccggcggatcgcaccgggggcaaagcaggcgccggaatggctgattgacgacttagaaagcggaacgccgatcaaagccggccctttgatcgtttgtcccgcccacgcttccgtcacatcgccgatccttgtcacatggcggtcgttgaagagggagccggctttttgcagaaacggatacttatccaagagcggctccctcccttgaaacgaccgtcttcccgttcttgatgacacggcggacatgattgacgccgtaatgatacgggatatacatgtaattcggcgcttcccaaatgacaatgtcagccgcccgtccggctttgatttgtccggcctcttcgccttttccgatcgcatacgcagcgttaacggtgacagcgtgccagatttcttctgcggtcatttttaaatgaagcgcggcaattgacataatgagctggagattttccgtcggtgagctgcccgggttgaagtcagtcgccaaactgacccgtacgcccgcatcaatcatctcccgggctctcgcataagtgtgttttccgagatagaaagtcgtgcccggcagcaggacggcgatcgttccggactccgcaagcttttcgatgccttcgtcagatgcccccaccaaatgatcggcagaaacagcatgcagctctgccgccaattccgcgccgccgagcgggtcaatctcatcagcatggattttcaggccgaaaccagcttcagccgcctttttcaggtagtcccgtgactggctgacggtaaagacgcctgtttctgtgaaaatatcggcaaattgcgcaaggcctttttcttttatgtcaggcaaaagctgcagcatgcgattcagaaattcgtcagggctgttccggtactcaggcggaatggcgtgtgctcccataaaggtcgtgacaaggtcgaccggctggcgctcacccagttttttcgccgcggtcagctgtttcagctccgtgtctttgtcgagtccgtacccgctttttacttccgcggtcgtgatgccgtatgacagcatgcgtccgaggtgaaaaagccctttttcaatcagttcttcttcggaggcggctttcgtgtctttgaccgttgacaaaataccgccgccttgcgccagaatatccaaataagacatgccctgaatttttaaattcagttctttttcgcgggaccctccgaatacaagatgggtgtggggatcgacgaggccgggggtgacgagccgtcccccgcagtcgataatgtctcctgcctcgtatcctttctccgctccttgatgtccggcaaaaacaatgcgcccgtcgtgaacgccgatgacggcattttccgtgacatgaagatcctgcatgctcccgccggatcgggggccgccggattccatcgtcagcagctggccgatgttggtgagtatggtatctatttgtttcggcatgttaccgctcctttttcatcggtatcataatgtcttgttcctcggcgacttgaaccgctttttcataacctgcgtccgcatggcggatgatgcccatacccggatcgcttgtcagaacgcgggaaagccgttgttccgcaaggatgctgccgtcagcgaccgcgaccattcccgcgtgaagggaataccccatgccgacgcccccgccgtggtgaaaagaaacccagcttgcgcctgaggccgtgttgatcagcgcgttcagcaccgcccaatcgccgaccgcgtcgcttccgtctttcatcgcttctgtttcccgattcggagaggcgacagatccgcagtctaaatggtctcttccgatgacgatcggggctttcagctcgccgtttctgaccaattcattgatggcgagccccatcttttcccgttcaccgtagccgagccagcaaatacgggacggcaggccttggaacgtgacttttttctgcgccatgtcaatccagcggtggagggcttgattttctggaaacagctcttttaataaagcgtccgtgcggtatatatcttcagggtcaccggacagcgcagcccagcggaacggcccttttccttcacaaaataaaggccggatgtaggccggaacgaatcccggaaaatcaaaagcatcggcgagaccctcatctttggcagcctggcggatgttgttgccgtaatcaaagacgatagccccttttttcttgaaggcgagcatggcttccacatgctttttcatactctgcttggaaagccttacgtataaatcaggctgatcccggcgcaggcggtcggcctcctcaagtgagtatcctgccggaatatagccgatcagcgggtcgtgagcggaagtctgatcggtcacgatgtcaatatggacgccgcggttcaaaagctcatgatgcacctctgccgcattgccgagaaggccgatcgataaaggttctccggcttgtctggctgtttcggcccagcgcagcgcttcgtcaattgatgcggttttccggtcgcaatagtttgtttctatccgtttatcaatccgtgtttcatccgcttcaacggcgatgacgacgccatcattcatcgtgacggacagcggctgggcgcctcccattccgccaagtccggccgtcagcgtaagggttcctttcagactgccgccgaaatgctgtctcgcaagctccgcaaaggtttcataggtgccttgcaaaataccttgtgaaccgatataaatccagctgccggcggtcatttgcccgtacatcatcagtccttttttctcaaggtcatggaaatgctcccaatccgcccatttcggcacgaggaccgaattagccagcaggacgcggggcgcgcggctgtgcgtgcggaacagtccgaccggttttccggattggatcagcagtgtttcatcatcttttaacgttttgagggagcgctcaatcgcgtgaaaagcatcccagtttcgcgcggccttgcctatgccgccgtatacgatcagatcctccggcttttcggcaacctccgggtcaaggttgtttcggagcatgcggagcacggcttcctgctcccatcctaagcattcaagttcggtgccgcggccggcgcggattgatttctttacatcagtcatcttgtaagtcctccttcattggtcatcagtttttggtgatgctcattcggcagaaaagactccttcttcagccagtcactcagatgttcgatgtcataagaaaacacgcggtcttcttgtatggacggcacgatgtttctcatttcgagatagagctgttttgtgtacgaggcgcaatgttccgcaccccggtattccacggcctgcagcgcgcaaatggcttcaacggcaagcacccgtctcgtattcgcgatgatctggtaggcgtgccttgaggcgatggttcccatgctgacgtgatcctcctggtttgccgatgaaggaatggaatcgacactggcgggatgggccagggttttattttctgacacgagggaggccgccgcatattgcatgatcatcgctccggattgtaagccgggctgagggctcagaaagggcggcaggtcattcagctgcggattcacaagccgttcgatacggcgttcagaaatattcgcaagctcggccgccgccactttgagaaaatccatggcaaaggcgatcggctgtccgtgaaagtttccgcctgagatgattttggcgccgtcttcgaaaatgagcgggttatctgtcgcggcattcatctcaatttctaatttttcttttacatacgctaatgtctgccatgatgcgccgtggacttgaggaatacagcggatcgaataggcgtcctggacacgcagctccccttggacggtcgtcagcttgctgtctgacaagtaatagcggattcgctctgcgacatccatctgttcctgatatccgcgggcggcatgaatgtcctcgtcgaacgcatcgataatgccctgaaggccttcgatcgttaagctcgcgatccgttccgactgataggccagcttttcggcctcgaggtaagcgatcagtcccatcgcggtcatggcctgcgttccgttgatcagcgcgagcccttccttagaggtcaggacggccggctgaaggtttgtcttttccaaagcatgagctgccggcatccgggccccttcgtaaaagacttcgccttgcccgataagcgccagtgcgagatgagaaagcggcgccaaatctccgctcgcccccagtgacccttgctgcgggatgaccgggtgaatgcgatgattgagaaacgcgagcagttgatcaatcagctcagtccgtacgccggaaaagcctttcagcagggcattggcgcgcaaaagcagcatggcccgcgatacagattccggaaacggatcaccgacgccgcacgcgtgagaaagaatcagattcagctgcagatccgcggcgtcttctttttgaatcagcacatcgctgaacttgccgaaccccgtcgtaatcccgtaaatggtcttctcttcttgaacgatccgttcaaccgccgccctgctttttttcacacgttccatgctttcggcagatgcttgaacctcttcaaaatcaaacagcacacgctgggcatctgcggttgtcagtgaggaaccgtctaacgttaccatcatttcaacccctttttctttactttggtaaagcgcccatacaaaaaggagctatgccatgaaaatgatatttcacgcatagccccctatcatctgatatctatgggctgattcatatgtgattaattccgactccgaatgtttcgtgctcaagccccttaatcggagctccgatcgtgccgtaaagggaaacggcgatccaatcgccttccgcctcgctttcatacggatttccccgcaagacggcaaacttcaggcccacggtacgaagcagcgagccaagcagcatttcgccccgcgtcactccgtgcaaagcttccattgtggcatgatacagcgcatgtgattcgcgataaccctcagattgaatgacgccgctctttttggaagcggtttcaattgcagctaccaccttatgcgcatccattgaacccaccctgccgagacagactttccagccgtcccgttccagccggctgatctgctggttttcttcagtctcatgaagcagaagaaggacggacaatcgcccgatgcggcggtctttgtgtaaggtcatatatgcttcactcaattcttaaatattctgataactagtaactgttttttatattaagtgtttgcgaatcagaagtcaaaactttttttccagtctttcacaaatcagattgctattgtattaaagcggtacatcgggaagccggcgctgttgatcacatatttccgccatccgcgtcataaaatagagcgttgtcttgaaagcgttttaagaaaagaagagagcgaggagatttcagaaaatgaaaaccagtttctttcgtgtgtgcctggtctcagcagcggttatcgggttcactctgccgcaggcaaaagcccagcatcccgttttttcagaggtcagcgtgcatgatccgtccgtcatcaaaacaggcgatacatactatgtattcggctcgcatttggcttccgccaagtcgaaaaacctgatgcagtggcagcaactgtcttcaagcgtcaatcccaataatcccctgatcccgaacgtctactccgaattaaaagagacattcgactgggcccagtctgatacgctgtgggcgccggatgtggctcagctggctgacgggaaatattacatgtactataacgcctgtaaaggagactcgccgcgatccgctctcggtgtcgccgtgagtgacaaaatcgaaggaccctacaaaaacaaaggcatctttttgaaatcaggcatggaaggaaaaagcgaagacggcacgacgtatcatgcaaacgttcacccgaacgtcgtagatccgcaaacgttttttgaccataaaggcaagctctggatggtgtacggctcttactccggggggatttttatactggaaatgaatccgaaaaccggtttcccgctcccgaaccaaggctacggaaaaaaactgctcggcggaaatcacagcagaatcgaaggcccgtacatcagctacaatccggaaacgaaatattactatctgtatctgtcattcggcggacttgacacagccggcggctacaatatgcgtgtggcgcgctctaaaaatccggacggtccgtactatgacgccgcaggccataacatgcttgacgccaaaggaaaagacggcagtttcttcgatgacaaagcaattgaaccgtacggggtcaaactcatgggcggctacagcttcgcctcacaatctgaaaaaggcacgggctacgtttcaccgggacacaactccgtgttttacgacgggaaaacgaaacgatcatacctcattttccacacccgtttcccgaacagaggcgaagagcacgaagtcagagtgcatcggctgtacatgaacaaagacggatggcccgttgcagcgccgtaccgctacgcaggagaaccggatacacacatatcggcagccgccgcatccggagcctacaaactcatccagcatggaaaagacattacagctacgatcaaaaccccaaaaaccatccggcttaacaacgacggcaccatttccggggaaatgaccggaacctggacaataacgaacagcagcaaagcccgaatcaacctgaacggcacacattatgacggtgtcttcctgaaagaatgggactcagcgagagagaaagaagttgtgacgtttagtgtgctgagcggtgatggggaggctgtttggggagtgaagtgaaaaagcacctactccagtttggagggtgcttttttcttgctaattaggagaatgaccttctattgcttttaataaaccatttgaattatgatggactcaacctctatcgtttacagtgaacagtataaaattgataacaaaaatatgaatacatacctaagaaaaaacgaaaggaagtttaattttgaaaaaaacaataaaagtagccgccgcagttatacaaaatgaaaacaatgaaattctatgtgctctacgttctccaacaatgtctcttcctaatctgtgggagtttcctggtggaaagcttgaagaaggggagaatgctcgggaagcacttgtaagagaaattgaagaggaacttgattgtaaaattgttacgggcgatgtgatagctgatattcatcatgaatatgagaaggtcatcgtcaatttaatttcaataaaagcgaggattgtatcagggaagccggtagcaaaagagcatgcggaattcagatgggtgcctattcgtgagctagaatcactagagtgggcacccgctgatcttccgaccgtatctgctttaattcgttaaatccacatacaagttttctgggacaggctgatggagcttccatttgacattcattggcttgtctccgtggcttgatacgtaatccgcttctcctaaataaataaatggtaaagtgatgttgtgcatttcagtgaatttcctcacaaataaatgaatatggtatcctttttccttatggtgaataaagttttgccctacgcttgatatatgtgaggtttggttttgactttgccagtgaaaatggctaggatcaataaaataatctttatatagcaaatgatcttctactttttctgacttattcaaattgataaagattaaatagtgatttttaactctacgtacaccctctcgccaagtcccttcctgatcagttgactgaaaaagataaatgagctcatttcttgtataggtctgatacaatgttagcttaatctcttttgaagcaagggcttctatattgttcatacgtctaaattcaatcagtccatagtggacgcgctccttaatatacggtccgaataatggatcggttaaaatctcgcttacttctggatctaacttgaatgtatcaccttgtaatgtaccaaagcgccaattctgtttttgatctgatttcgttaaacgctccattgctcgctgaatgaggtcatcatgtgtatctgttgtgatttgaatatgaaactgtttttctaacgattcttttacatcttctattgtgatgatatttttgtgaaaaccgctctgtaaaattaaccattcataaggccatttaataggtaattgctgttctaatcttgctactatccctacaaccaaggggttattgagaatcccttcatctgtaacattcaaatcgtccattttctttttggtctgtacccacgatttgtatttctttataaaaaaggtaagcccaggtgcctgttcagagtatagaaaatcaattaattctggagagcgccctagctcttgtttaaattgcttgtataacgttttcagcatggcatctgaatttagtttaatgtgatcgatcttatttaaaatttctttcttcgttatggctgaaaggtcaacataagatcctccaggtaaatctgaaaactcatgcgtcacggccactcggagggaatctttatcaaaagatttttggcttgtttgtccagatagtgcgagtggaataacgaatgacttttgatagtttccgataaaatccagtatcgttacaaactctttgtcgtcagtttttctaagtccccgtcctaattgctgaatgaaaatcgttggtgattccgttggtctaaggaacaatagtagattgagctttgggatatctattccttcgttgaaaatatctactgtaaatataagttctaaactgtggtgcgggtcctctaattgacgaatgacctcttgtctttttgcaggagaatcatttcctgttaaataagttgtataaaaacccaatttattaaattcatcactcatgtatattgcgtgttcgacgtttgtacagaaacctaagccaaccattttctcgccgtggaatccatacatgttgatcatcttgatgatatattctactcgtttatgcgtttttaaatgattgactagcgatttctcttcgtacagtccgtttttcacttttactttttcgtaatctacagtatgatctgaaattccaaaatagtgaaatggcgcaagtagctctgcctttagggcatcgcggagtctgagttcataaacaacattatgatcacaaatctgaagcacatctttaccgtcaagacgctctggtgttgcagttaaacctaataaaaactttggtgtaaagtagtttaatacagcttgataggtagatgcttctgcatgatggaattcatcaatcacaatgtagtcaaactcatctgttgaaaaagattccaaagtatcttttttatgtaacgtttgtatagtgctaaataaaaaacgcttatctctttcttttttcgtgccagtcaataagccaaaatcttcatgattatttgtgactttcttgaatgtttcgattgcttttgaaagtaactcttcccggtgggcaagaaaaagatatttatttggtttaaattgctcaaaatcaaatgctgctaaaaatgtttttccggttccagtggcggcgatgatgactgcttttgtctccccttcgtttcttgtttttttaaggtttcgtaatgcttccttttgcatggcattcggggacattttcgttttgtaaagagagttttgagcagcaaaggaagcacttaccttttggcttccagcttggaattcctcataggcttgtaaaaattgttcgtcaacaggctgtgtcttttcattccaaacagtgtcaaacaaatcttttgtttgttgataaacggggagatatctggtttcaggtagtctcacatttaactcatacccagtcgtaagggcagcttgtgatagatttgaagatcctacaatgacactatgctgtccagaacagcgttcaaataagtatgctttcgtatggaaagattttttatattcatttacaattctcaactcaacattttcaaattgaagaagatgtcttaacgccttcggttctgtaatacccatataggtagatgtaatgatgcgtacagggacatgtcttttagcaagctcctgaagcggagggatcaaaagctgaacaccagaccaccttgtgaaactaaccataaagtctacccgatccgccgttaacatttcgtgttttattgctttgaaaaagttctcatgagtttgatgatttcctagcagtttcagacgatgtagagaaaattcctctgaaataggaagttccatttcatttaaactataaagcactgtggaaagtggcaatgaaaaattcgtatgttttccaagctgagaggcgaccttctcgctcagctgaatcgcttgttcatattgatcttgatccacaagtgtttgaaatgtctcgctcagttgttttgccgtatgtaaagtcaaaacttctgcatattcttttgggctgaccggttgaatgcgatgtgatgttggataaagtttttgttgttgctgaatttcctcatggaagcctctatgatttctcatcataatctccttttttatatcaataattccattttatcactacttttaccaataggtaatactgaaaaagaagagaataaagtcctatttattaagcgcttaaaaaataacgctgaggtagtttggtttggtataaagacgtcatcgccacaaacggagaaagtctgtaagcgcaatgttccggagaaagccggcaaaattgacattcagcaaagagaggaggacaataaaagcagaaaggcgggattcatatgtttaaaaaaattcttgcagcagtagacggttcagacatgagcagcaaagctttggacgcagcgatccatctggcgaaagaacagcaggctgaactcaccattctttatgcgggacgtgaagccgttgtctccacatcagccttaacagggattgtctatgttccggaaaacttcattgaagacatcaaacatgaagtcgagcaaaaaggagcggccattctggaaaatgccaagcagaaagcggctgaaagcggggtaaacgcggaaagcctgtacgtccaaggcgaacctgcgcatcaaattttaaacatagcgaaagaacagcatttcaatctgattgtcgtcggaagccgcggaatcagcggatttaaagaaatgatgctcggaagcgtgagccataaggtctcacaattgtctccttgtcctgtactgatcgttcattaaacagaagaccctgctgatgcggggctttttttaatgagaaaagaccgccgtctttcgaaaaataggatgaaatcttcctctgaatcaagtaaaatggctgttagtatttgtctgaataaacagtcaatgatatgggggaagcaaatcaatgcaagctgaacaaacatcaaatgccgtcatcaaaatggtcatttccatggtcattttcggatcaatcggctttttctcggaacatacgaatgttccttcaattgaactggtctttgtgagatgtctgtgcgcctctttgtttctgggcgtttgctggtttggttccggacggcaccgcaccgaacaatggaaccggcgcgaggtgttgcagacattggcctgcggattttttctcgtgctgaactgggtgtttttatttaaatcgtttgaggagacatcagtgacgatagccatttccgtttatcatctggctccggttctcgtccttcttctagggagccttatataccgggagaaactgcatattgtgtccgtcacttccatcgtgatttgttttctgggcaccgccctgatttccggcatcaacggaaatacgtcattttctcagctgatgggatcgggtattatttgggccgtgctggccgcccttttttacgcctttacgacactggccgggaaaggtatcaacagtctcagcccatatgcggtcacctgtttgcagaccgggttgggcgttatcattcttctcccgttcgtccgtttcggcgctttttctgatttgtcgcatgtgaactggatcatgattgtgtcaaccggtatcattcatacgggaattgtgtatttgctcttttttgacagcttgcggtttttatccacccggtttatatcaatcatcgtatttcttgatccggcggtggcgattgtgcttgacaccgtatttacggggtttcgccccgacctttatcaatctttggggattgtgttgatttttgcgggaatggcactgtccctgattcgaaagcaaaaagccgtgccggcggaaactcaggcagacagcacccgtatataggcggccgtatcggctgctttttttgttttggggcttttcagccataacgaaaaagcagacaaacagatcatggaaaaagaggatagtaattgtataatacttcatgtgtttgcaatttaagagattaaaggagtgaagggcatgaaaaagaagacgcgtcatctcgctttcttggctgcactcggctttgcgctttgtctggccatcgtatgttccgcatccaagcaggcagaagcggcagcggcttatccggatgtgatgcagggacttaccggattcgctggcaatgcgaaggatcataacggaaaagcaaaatccgccgtatcgggaggccagggcggccccgtcgtctacgtcagcaatctcaatgatctgaaaaacaatgcgggcggaacggaccgcaaaaccatcgtcatcacaagtgatatttcttccccggggaaagccgttgtgacagtcggcgccaataaaaccatcgtcggctcttataccagccacaggctgaccaacatctatctgaccaccggctccggatcaaacaatgtgattttcaaaaatctcattatcagccataatgccgccattacaggcaacaacgacattccgatgtacatagcgaacgggcagaattactggattgaccacgtgtggtttgaaggacacagctacaatccgaacagccacagcgatttgggaaagcttctgtatgtcggcgccaaagcggattttgtgacgctgtctaactctaaattcacagaccatctgtacggcctgattctcggttatccgaatgatgataacgaaggacgcaattatatcggctatccgcatatgacgatcaccaacaactattttaataacgtctatgtgcgttcaccgggcctgatgagatacggctattttcacgcgaaaaacaactatgtgaccaatttcaatttaggattcaccattcatacaaacgcgactgtcttctcagaagccaactatttcggtaacggaaatgaaaaaggcggaatgatagacgactacgggaccgcccaattcaccgacaccggttcattcccgtcgctcaaagccccgaaatcaccgcgcaccggctggaatccgagatcaaattacagctacggcacgctttcagcccaggacgccaaaaacttcgcccaatcctacgcgggagcgcaaaatacaaatctccgctatccataatacaaaaaaccgccggcagccggcggtttttttatatgaataaaaggttcaaaattcctataatccttaaaataaccttaaatacctaggaaaatattgataaacaatttcaataatattactattgttaagcctatattacaaaagaaggaggagaacctatgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgagaattcaaaactttattatgagggcgagggtgtatacaaacaggaaatctacacagaccccattcatacgaaagaaaccgccaatgcggactgggaagacatttctcctgaattgaaaaccggctcaaaggatgtcgggacggaaaatacagtgctgaactccgattttctgaagcaaatgaaaaacggattatacgctacatttgaacacggtgatcataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgacaaagacaatgtcgtctacaccgtgccgaagccttttatgaccgactcagatctcgacgagaagtcaggtgaggtcagcaggtcagaagatgtcagcttcaagcttgaaaaaaacagcgaaggctacttgctgcatgtaacggccgatgaaaaatggctgaaagatcccaagcgggtttatccggtatctattgatccttccacatcagtatccgtgtcatccgatacctttgtcatgagtgcgtacccgacgacaaactactctgccgcgtcgcagaaatgggaggccggattgaaagcgtacgtgctgaaaacaggttattatgacggcacaaccggaacgaactacgcatttatgaagtttgataatctaaagccgatcaaaaacatgacggtgacaaaagcgacgcttaaagcatacacagcccactcctattacggatcaaaggcgacggggctttggctcgacaccgtaaacagcaattacgacaatgccaagatcacgtggaaaaacaagccgggctccaaaaacatcggcaaagccgaggtctataaaggccaatgggcaagcttcgatgtcacatccgcagtcaagtcgtggaacagcggcggcgccaattacggctttaagcttcacacaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggacttttcaatatcagctggaaaaaagctgaaggcgccaaaagctataaagtgtggctttataacgggaaagaatatcaagccatttctgtcggcaatgcaacctcttggagcacaaaaggaaaaaacatctggccgacaaaagcagaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggcagagttcagaaaccaagcacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaaaatcaaaacatctggccgacaaaggcggaaatcagcgccggaaaatatgcgcttcacctgaaagacaaaaaaggcgcggaattgccgatcaacccgggccccgtttataaaaatgccggcggagacgcaaaccggaaaacatacggatttaaagtaatcgcctataacaaagacggagaagcgatcgcctcaccggaagctagtccggcgctgcctgatatcgcaaagccgaaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccgtcagccgatgaagtgaaagcgggaaaattccagcttcacacggacggaaagggcggcgaactggcgcttgacccttcacctgtttacgaaaacgcaaacggcaattacaaagggaagaagaactattcctttacgctgaccgcctatgacgcaaatggtgacagtataccgacggcaccttttaaccctgttttccatgaaggtgcggaattcctcggaacggaagaattctggtctattatcgacattccggacggacagctgaacggcgcgacgggaaatgtcatcgtcaatgaagaagatatgtcaatcgacggacgcgggccggggctcggactctcccggacctttaacagccttgacagctctgaccatatgttcggccaaggctggtatgccgatgcggaaatgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcgggcaccgcctggccaaagccgttaatgcgaaaaaagaaacgtatgattacagctatgacgccggcaaaaaaacgctgctcatgacgcagccgaacggccgcaaagtgcagtacggctataacgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgctgtttctgagacggatcaaagcggaaaatcctcatccgccgccgtgtatgacaagtatggaaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacctttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggctaaagcagatggctggagcacaagcggagccgccgctgaccttgatgaaggcttcgatgatgacagctcattaaaagcgtcccgcacaaatgcatcacaagccaatgcggccgcaaaacaaaccgtcacattaggccaaagcgcggacgataagccggtatatatcacgctgacagggatgtccaaggcagacggcgtaaaattaacgaacgacaatgattacgcgcttcaggccggcgtcacctatgcggacggcacgacgggcgtctacaccgccaaattcccgcaggggacacaggaatggaaccgggcggcggcagtcattccgaaaacaaagccgatcaataaaatcgaaatcagcattctgttccaaaaaagcgccacaggaacggcgtggtttgatgacatccgattaatcgaaggaagcatcctgacgaaaaacacctatgacgaaaaaggaaactacgtcacaaaagaagaagacgaactaggttatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcaaaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatcattcaatatcatgaaccagctgacgaaggtgaatgacgaagacctgtcctatgataaaaacggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaaaggggaaataagatggatcactattttattgatcatcctaaggagttaaaagtctatcaatccataattaattccttatgtcacgtagatcaaacattgcctaaacaagtttttaagcaaaggaaaaattattatttattcgaggaattccattgggtattatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgttgtttgggcttcaccgactttaaagtgggcgatttatggtgagagagaacttgaaatctgtattctaggtattgatcatcagagtgaaggaaaagaactagcaacttggagatcgttagatggcgttgtcttagattggatatcagttgtattcccaaatcagacggttccagttgaatttgaaaaaacacttacggcacattacaaataagtatatttttaatacctactaccgatatcatctgattgttctaaacgggatttcaaataatctccagatagtatttttgcattcaacagatatttaatgacaaatatgcagagtaatatatttttggggcttgtttgaataatctatgtttatcatcaagacacttctatcaatgggtttgttagtgttagttaggagaaggagaagacaatgcacaaacaaattgaacaatagagtagattatattgacgagggatgtaatattttaaaggtcgattatcagttctttaaaaaagacctgttttaaggttcaggttgttaaaaatgcagcatctgtttattttagtgcagatattggtgatatgagattagaaaaaatagattcggaagaatacaattggcaagtatttgagatgagttaccacccggaaggaatcggtaatctatcaaatgctgtaattccggagtatcaatcaaatgctaattttctcattgacatgaacagaatgctgattgctgtagaagctgaaacagttcgctttgacgaccaatcattttatgcgtatcatccgaaatcataaataaacaaataagagaggttcccagcctctcttttcttacataacgaaatcgttcgcggaggcaaacatgaacactcctttaaatttacaaaaagaatcattgagggctatagggaatctggatgtgattaatccgcttaaatacaattcgatttattcatgtgatctagtgagtaaagatactttttctcaaattaatgaatgacttagagttcgaaacagctctaatagaagtaatggcattcccttcttttattgaagaatggaagaagaaggttgaaaagaaaatgataaatatgaatactgtatcgaaaaagttcattcatattgaatgtgtcctaaccaaagaagaattgatggcagattacttattagatgaattatattttttagcatcgatcaatgattttgttgttataatagcaaaccctgccaaaaataagtcctgcatgaacctgaacactcaaaaggttgatgtaactactgaaagtaatgaaaaaatcatttggtttgaatacgatgcagcagatttatatatcattgattaatttaatataaatttcaggttcctattcaacggagtgttgctgatgttaaaacttaccgcggagcgtgttgggtcatatgaaagggaaaatatcatttatttcaatgcgggtcgggatgatcaagtatttattgtgtcggtgcacgatcacaaagtaatattggaggttatgaaaggcagctctcttttaatcaaaaaagagttacacggattttctgaagatgcccatttctatctgattgattcgtatgatgacactatcgtgatcgtttacctggagaatcatacgtgtcaattggctgcatactgcgtaaacagtaataaaatcaatccgatttgttcttttctattaagcgccaatgtatttcatctgggtgaggatggattattatggatcggattaacggacgagggtatgtatgatgagagaaatcctcaaggaaaagcgatatttgcttttcatgcagaagacagaacgttttattttgaagacgattttaaagaaatgatgcacgaatgctatgccgtacaatcgatcaaatctgatttgtatgtatgtttcgagggagaggattgctgtgtcatcgggcattatcagattggacgggacagaattcgtactgttgcagaatatgtgctggacggcgatcaatactcctattgtgatcagctatccgtttcgaaaaaaagggtgctgctgattcagagtcacgatgataccctatttgcatttcatgaagagcacaaagagactgacgtcatgatacacggtattgatagaaaaggagaaacaacgtacagagccgtacaggatcgcatgtttatctttagtgataacgatttatatctggtaaagtattgatcaatcctatgcagatggctttttacagccatctgcatatcattttacggagtgaacgatcgatataaataggataccatccaagactcaaggggcaatgacatgaaaataaaaatgaataagatagtcgaagaatcagtaaaaggatgtttttgtcattttgataactgcgggcgtctgtatctcggacggcatcagaatggcgggctttcgtttacgatcatcgacaaatcgggcgatacgcgagtgattcatatcgatgaacaaatcccgtatgaggatattatgctgttccaacagagttcggctgactggtatgtgttgattttctttgaatcgcatgagtataaagtgaaagtattttcagcagaaggaacagaacaaagtgcattttctctcccttcaggggtttcatgcagtcttttggatgaaaaacaaaacctgtggatcggtttaagtgatgaaggtatttatagtgatgaaaatcctgaagggcacagtgtgctgtgcttcactttagacgggcagctaaagaaaacccacattgatcagcagctttcagaaatatatgcgcccgcggtagatgactgttatgcacttgcagaaaaagacggactaatctacatgctgtattacgcttatacagtcattgctgcgtttgaagaaaccgacgtgaaacgagtgtggattatttctgataaagcatattccggggtttacgaccagctagcgatttcagataacgggttttgggtatgcaaagatgatcattcactgtctctcattccggccgatgtcagtctgccgatgcaagagataacgtgctgtgatgcggatggcgatgagctttccgggcatcagctgaagctgactggcgatgccatttacgcggtctcgaattcagggatttataagcgggatatcagtaatgggaaagcggctaaatgagatgttaagatccaacagatattctttaaataatgacgtcatcagaagcttgaaattacacaaaaaagaattagaggggccgctgccttcagatgcagggagattcgaagaagactttgagggtgctgcctgcgctggggatttttatgaatacttcgcacttgtctgcggcagcttagattttgttttggcgaataaacaaatgcctgcacggcagcgtaaagccttatataaatccttttttgagctgtatccgcaatatgcgcagctgaaaaacgctttgatggattatccggagctcagccaggaaatcgggcggcacgaacgggccaggaggctgttagtcagcattttaaacaagaaatgaaaggcaggattttgacgtgaaagaacccacaagagcagaatgtctgaaaaaggctggtctgatcctgaacggtcaagcggcgagggaagaagtgtcggattgggcgtctgagtatgtgagtgcaggtgatccggcggatgaggacgaaaccgtttgggagatgctcgtatatttgagcgggtttgatctgaaagattcgcctgatgcgtatctgcatacgatagaagaattaagagattgggtgcaggaatataaagaagttcatggggatttgtaagaaaaaaattcatttgagtcagacatgtcaattcagctgaaaaaaaggaggcgcaaaatggaatggcacaaacatgagaaagcagttctgccggggccaggttcgccgggttgttttgaattgacggagtttacgttctataccgggtataacgagtattatgataaaatcccggtgtttgagctgaagctgactgacggacagtatgatgccgtgctgcggtttgaggatgtgaggtctgcccggctggatgatcttgaaagcatcaccgacatccatctggatatcagcccagtcgacggcggctgggaatcgatccgctactatgtcgatgacggggaaggaagtatgagcttttattgcgccaaatgggtcgtgctcgacatgaagaaaaagcagtcccccgaacggcccggcaaaacgtcagggtaaagcggcggcatttcgcgtataatgaggggagccggacagagaaggagtttagtcatgaatgagtttaatgaatatgcgatcagccccgagatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggagtgggaggaaaacaaaccgcaggccctgattttaacgccgacccgcgagcttgcggcgcagattaaagaagatatcacgaatatcggccgtttcaaacggataaaagccacggcggttttcggaaaagcttcttttgacaaacagaaaaccgaactgaagcaaaaaagccacgtcgttgccggaacgccgggacgtgtgcttgatcacatagaaaaagggacgctgccgcttgaacggctggcgtatgtggtgattgacgaagcggatgaaatgctgaatatgggatttattgaacaggtggaagccatcattcagcatctgccgaaaaacagagtcaccatgttgttttcagcgacgctgccggatgacgtcgagaagctgagccgcacatatatgaaagaccctgaattgattgaagtaaaagcggaaggcctgacgacaaaagacattgagcattttgtcaccagaacagaagaagaggataaatcatctttgctgcgtgatgtcctgatcaccgaaaacccggacagctgcatcatattctgccggacaaaagaaagggtcatccagttaaccgatgagctggacaggctgggctacccttgtgataaaattcacggcggcatggtgcaggaagaccgctttgacgtcatgaatgaattcaagcgcggcgagttccgctatctcattgcgaccgacgttgccgccagaggaattgatatcgaaaacatcagcctcgtcatcaattatgatattccgcttgaaaaagaaagctatgtgcaccgcacaggcagaacgggccgcgccggacaccgcggacgggccgttacgtttgtgacgccggctgaatcgcggtttctgaatgacattgagacatatatcggtttccgcatccaaaagcgggaggcgccgtccgagaaagaaacagcggaacggaaagcggcttttgcggaaaaattgaacgcccgccccgatgtcaaaacagacaaaagcgaacagttaaacaaagacatcatgaaactgtactttaacggcgggaaaaagaagaaactcagagcggtcgattttgtcgggacgatcgcgaaaatcgacggcgtttcagccgatgatatcgggattatcacgattctggacaacgcaacatacgtcgaaattctgaacggaaaaggcccgcacgttcttgacatcatgaaaaatacgacggtcaaaggcaaaaaactgaaagtccataaagccaagaaataaaatagaaagcctgccgcgtgcaggctttttttacgccgtttcctcaggcacaaacgcaaggatggcaatgccgatcacaaataacaaaatcaggctgaacacggcggctgacgaatttccggtcagctgggcggtgacggcaatcaaaagcgggccgataatcgaagcgaacttgccgaagatattataaaatccgaaaaactcattggcgttctgtttggggacaagctttgcaaagtaagagcggctcagcgcctgaatacctccttgggaagtggcgacaagcatagccaaaacccagaaatcaaaagcggaatccataaaataagcatacgtgcagacaatcatatacacgccgattccggcataaagcattgtttttcctttaaaccgttcggccagccgctcgtacaaaatcgaaaaaggggcggcgacgacctgtgtgacaaataaaacaatcagcagatttgccgcgctgatgccgaggtcagccccgtatgacgtggacattgtaatgatggtgccgaccccgtcgatatagaagaaataggcgagcagaaacaaaaacagcgcccggtgcttcctgatctgcttcagcgtgccggccagccgtataaaactgctgatcacaagccgcggctccctctcgatataatagcgctggcggacgcggagaaggagcggaatcgaaaacagtccccaccatgccgccgtaattaaaaaggcaatgcggcccgcagtctgggcggacagcggaatcacctccgcttgtgctgacagaatcacggcaatgctcaggagaaaagggattgtactgccgatatagcccagcccaaaccccctggcggacaccatattcatccgctcctttgcggccacatcaacgagaaacgcatcataaaacacattagatccggcaaagccgatcgtggaaatcgtataacaaattaataacagcatccaagattcgccgggaatcaaagccagcgcggcggtgcccgccacaccgatcagaaaaaagaaggcaaaaaaccgtttcttgcatcctttgtagtcggcaatcgttcctaagacggggctgagcatcgccaaaataaaagtcgcggcggcaatcgtatagcccaaataagcggtggaatcagctgcgctgacgccgttttccgccgccgccgctttaaaaaacaaggggaacaccgccgtcataataatgaccgaataagctgaattggcccaatcatacagcatccagctgctttcttctttcgaaaaccgtttcatcacacacgctccttcccaaaaaccggttctctgcattatatgcgcctctgcctcatcgttggacaatgatttctgaacggcgttttctgattgacctggagatattgacctggtacaaaaaggatgtacaatcaaggtgtagcaggtaaatggtcaggcgggagggagacggaattgaagattgcgaaagtcaataataataatgtcgtcagtgtgctcaaagaaggcaatcaggaattggtcatcatgggccggggcattgcttttcaaaagaaaacgggagatccggcagatgaagcccgcattgagaaagtgctcaccctcgataacaaagatgtatccgaagttcaaaacccttttgtatgatattccgatcgagtgtatgaaagtatccgaggagattatcagctatgcgaaattacagcttggcaaaaagctcaacgacagcatctatgtgtcgctgaccgaccatattactttgccattcagcgcaataagaaagggctggatatcaaaacgccttgctgtgggaaacgaagcggctctacaaagacgaatttgcaatcggaaaagaatcgctgatcatggtaaaaaacaagactggcgtgtctctgccggaggatgaagcaggttttattgcgctgcatattgtaaatgccgagctgaatgaggagatgcccaatatcatcagcattacaaaagtcatgcaagagattttgagtatcgtaaaataccattttaagattgaattcaacgaagaatcgcttcactattatcggtttgtcacccacttaaagtttttcgcgcagcgtctttttaacggcacacatcgactttttgctggagaaaaataccgtcgggcgtatgaatgcacgaagaaaatccaaacttgcattgagagggcgtatgagcacaagctcaccagtgacgagctgctgtatttaacgattcacatagaaagggtagtcaaacaagcataatgaaagcgttggcattattgttcttggattcattttttcttacattcacatatgatcttgttaggattgttgctgataagcatgcaaaacctaaattacaatgagcgcggatcatttctgtttgtgctgatggtaatttaggtttttttaagattcgttattatcattattctgaccgatgttcccttttaacagaatcatgtatgatcgataaagaaatcgctctcaaagaaaggggaatgccgacatgttttatcgtatgaaacgagtgctgctcattcttgtcactggattgtttttgagtttgtgtgcgatcacttctgctgcatcagctcaaacaggcggatcgttttttgaaccttttaacagctataactccggtttctggcaaaaagcaaatggttactccaatggagatatgttcaactgcacttggcgtgcaaataatgtatccgtgacgtcatcaggtgaaatgcgtttggcgctgacaagcccgtcttataacaagtttgactgcggggagaaccgctccgctcaaacctatggctatggactttatgaagtcagaatgaaaccggctaaaaacacggggatcgtttcatcgttcttcacttatacaggtccaacggatggtaccccttgggatgagattgatatcgaatttttaggaaaagacacgacaaaggttcaatttaattattatacaaatggcgcgggaaaccatgagaaggttgcggatctcggatttgacgcggccaatgcctatcatacgtatgcgttcgattggcagccgaactctataaaatggtatgtcgatgggcaattaaaacatactgcgacaagccaaatcccgacaacaccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgccagcggaaatccttttttaattaaaacgaaataatcccaatcaaaagcgccgcaatcgtcatcacaatcgttgttcccacggcccatttaatagtgaatttttgatggtcgccaaagctgacgcctgccattccgaccaatagataggtggatggcacaagcgggctgagcagatgcaccggctgtcccagcaaggaggctcttccgatttcagcggcgtctattccgtaagcggaagcggcttcggcgatgatgggaagaacaccgaagtaaaaggcgtcattcgacatgaaaaaggtgaaaggcatgctggcaatcgccgtgatcaacggcagatgcggacccatggcatcagggatgagggaaacgagagaatgcgccatcgcatcgaccatttttgtgcctgagagaatgcctgtaaatatgcctgccgcaaacaccattgagacaacgtttaacgcattacccgcatgcgccgaaatccgtttctgctgctctttgacatttggatagttaatcatcaaggcgatggcgaacgcgatcataaaaagaacagggatgggaagcaggctggtgatcagcgcggccatcagagcgacagtcagcagcaggttaaaccactggagagcgggacgcttcagcggcgccgcctccggatcagaagacggcgcgtgttcaatcgaaatgatgccgagacgcttccgttctttttttccaaggagataagcaacggcgatcacccagagaacgccggcgatcatagcgggaatcagcggcgtaaaaacttctgacgtgtccaatttcaaggaagccaaaaccctcgccgtcggtccgccccacggaataatattcatgacgcccgaaccgagcatcgcaatccccgccagcaccaaacggttcatgccgagccgtttgtaaaggggcagcattgccgcaatcgtaatcatatacgttgttgtcccatctccgtccagcgaaatggtcatcgtcagaaccgctgtgcctacggcgatttttaacgggtctcctttgacaaacgataagattttggcaatgagaggatcaaacaggcctgagtcgatcataatgccgaaatacaggatggcgaataacagcataatcccggtaggagcgaggtctgtaacaccctgaatcatcatcccgccgagatctttgccaaatccgctgatcagggcaaacacaacaggaacgacaatcaaagcaataagtgcggaaagccggttagacataataaggtacataaaaacaatcatcatcacaaaaccgagtatggcaagcatgatatgacctcccctgttcaacagctgttttggtaagcgctttcacattttgtttctgtgaaaatggcttatttcaaaatgtgtatgaccgcatatgtaaatacagacctaaaatcctaatgagcggatcagcagtttatttaaagaacgccgcgggtaaatgtgctgtagaatgtttcgttttaaaagggggaactgacatgagtgatgatcaaaacaaacgagtaaatgaacactcaaaggacgaacagctggagcagtaccgatctgataacagcggcaaaaaaatgacgaccaatcaggggcttcgcgtgtctgaggatgagcattccttaaaagcgggcgtccgcggccccacgctgatggaggattttcattttcgtgaaaaaatgacgcactttgaccacgagcggattccggaacgggttgttcatgcacgcgggtacggcgttcatgggcattttcaggtgtacgaaccgatgacggaatatacacgggcgaaatttttgcaggacccgtccgtcaaaacacctgttttcgtccgtttctcaacagtggcgggctccaaggggtcagctgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgcaaacaatcctgaatccgcgcacatggtcatgtggacgatgtctgaccgcggcatccctcgaagctatcggatgatggagggcttcggcgtgcatacgttccgtttcgtcaacgagaaaggaaaagcgcgctttgttaaattccactggaaacccgtgctcggcgttcattccctcgtatgggatgaagcgcagaaaattgccgggaaagatcccgatttcaaccgccgcgacctatgggaaacgattgaaaacggcggcaaagtcgagtatgagctcggtgttcagatgattgacgaagaagatgaatttaaatttgatttcgatatccttgatccgacgaagctgtggccggaggagttggttcccgtcaagctgatcggaaaaatgaccctcgaccgcaatcaggacaatgtctttgcggaaacggaacaggtcgcctttcacccgggaaatgtcgtgccgggcattgatttcaccaatgatccgcttcttcaaggccggcttttctcttatacagatacacagctcatccgtcttggcgggccgaattttcacgagattccgatcaatcggccggtctgcccgttccataacaaccaatacgacggctaccaccggatgacgattaataagggccctgtcgcctatcataaaaattccctgcagaacaatgatccgtcgccggcctcagaagaagaaggcggatacgttcattaccaggaaaaagtagaaggcagaaaaatccgccagcgcagtgagagcttcaatgactatttttctcaggccaagatgttctggaacagcatgtctcccgccgagaaagaacatatcatctccgcgttctgttttgaagtcggaaaagtgaacagcaaggatgtgcagcagcaggtggttgatgtcttcagtcacgtcgacgccgggcttgccgagcgtgttgcgaaaggaatcggcgtgaacccgccgccgaaggaccgtgaatctgatgaaacgttcacttccccggccttaagccaggaaaacacggtgaagacggcagcgacaaggcaggttgcggttttaaccgaccacgggttttctgatgagaaagtcaaacaagtgcttgacgcatgcaaacaggcgggagtcagagccgatatcatcagtcctgtgcttggaaccgttaagggagaaaacggcacggagctcgaagcgtcagccacgttcctgacagcggattccgtcctgtacgacgctgttttcattccgggcggaaaacaaagcacagacagcctcaaagcccaaaaatcggccagagacttcgtcaacgaagctttcagccattacaaagcgatcggcgcctccggtgaaggaaaagaacttctcgccctcgccgccggaaccgaaagcggccccggtcttgttccggacggaaaccatgaacaatttctgaaagccgtggctgagcatcggcattgggacagaaacgtataagaatgaaaaagcgcctttgatgagaggggcgcttttttcttgtgaaagaatattgggagaaaacgaaaattgcttccgtacaaatccgtatcttccgctgtcctggacattcagacaacagttttagagagtcagggcatgcgctatttaaagcaggcgggttgatgaaataatagtttcaccctctttggtttacttccgccctgtgtttgtgtatcttaggggtagattttctggaggagcgattgatagtgaagccgtttaccgaaaaacaacttgaagaatattaccggcgtgacgaaaacatgatgattttggtgtttgcccaatggtgcgtcaatcatgaccttgatccgatggccatttacagcaaagcttaccccggacagcctttaaacgaagagctgcgaaaaacggctgaagagcttgtcgtgccgaaggaggaatcagaaccgattcctgatcaaaccgtcatcggcgttttggagatgttcggcaactccgatttggcggaagccgtttatgaagccattgcgcaaagaccttcacggtaaaagaggcgtggattatccatgtctctttttttcatggagaaaatgtgaaagaaggcccagaaacaatttgctgatctgcgctgtctatagagtgtaatccgttttcaaaaagggaacggtaatgaaaaggaggagttgtgatgaaaaaggcattcaaaatgatggcggccgtgctcttaaccgtgctgacagccgcgccgttcggaggtttcgcgccttcagccgaggccgcgcaaactgcaaagcccgtcgtcaaaagccagacgtataagcatgtaaagcagctgacgtaccccgaggtcacaaatacgggaaacgcatcttttgaaaagaaaatcaatcaggacttcaaacgctatattgaaaactcgtaccaagaatatgtaaaaaacaaaaaagacggtgaaaaacaaggctacaaagcggaataccaggcagatttcaaggtgaagtataatcaaggcggcaagctcagcattcagacggaaaactacagttacacaggcggcgcacacgggctgacagccgttcagacctttaattacgacctggccgcaaaaaaacgggtcacactcaatgatgtgctcaatacaaaaacgaaagccaacaaaacgagagactatctttacggctacatcaagaaacatgacgatctgtttgaccaggacgtcaaaaaacaagagatcatcctgaataacgaaagacctttcttctttacgaaaaacggcattgccgttgtgttggacaatatgatctcggaccatacgcggcaggaatccgggacgttttcgtgcctgcatccgtctatcaataaaaaaaagcgatatcactctaaaacggagcggtatcgctttttttattttaccagacaaacaatccgacaatcgccgcgctcaataaggaaacggcaattccgctgacaagcagcttccagacgttttttccgatgatggctgacttttcaccatcaagcagagattgataagatccgtagatcataccgatggtgctgaagtttgcgaatgatgtcaggaatgtcgtagccacggcaatcgtgtgcggcggaagtgatttcagctgccctttcagatcggccattgccacaaattcattcgtcgcgagcttgatgcccatcagctgtgcgacatacatcgcgtcatgtacgcctaatccgagaaggaaggcaaacggactgaagatgtatgagaaaatcttttgaatggtcaaaccgtgcatgaacagtccgagtacgccgtttaacgcagccgttaacgccacatatccgattaccatcgctaaaataacaatgaccatgttcatgccgacaagcatactgttagaaatcgtgggagaagaagtctttttctccgcttttgaaggaacgtaaataatatcatcctctttagaaacgtccacgggattcagcatattggcgattaaaagcgcgtttaagcaattcagcgggatagctgtaaacacataagtggacggaaccatcgtcaagtacgatccgatgatcgaaccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcgcagcaatgcgctgaagaaaaatcaaccgtcggattggccatgatagacggaaaagcgaacgcaattccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagaacataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagactgagagcatcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgttcacaagtaa

SEQ ID NO: 11 - DNA, 231132 bp, Bacillus amyloliquefaciens
tttaatatccatattggggaagcaatagcattacggagagtttggggttggaggttaaggatgtatattttgaatgttccacaaccaacagaggttaaggttggcgatactatttcttacaggtggtcatgttgaaaaagtaattggttttgaggaagatgcttctgtaatgttgagactggatgccttatgcatttgatcatttggatgctgataccggggatagaattttggctgatctgatgcggacaatacgtttgttctgtgggatgaggatatggtggaataaatgattgtgataaaaacaggccgatattttaatggcaactgaggacattatttgtcagcaagttaactgtaaaggagttatgggtgctggtttagcaaaacaaattcggaaaaagtaccctaagtgctttgaggactatagtttatatgttgaaaatcggggttatgatgcggatgtacttcttggaggggtacattatacaggggcaaaagtggaaaggtgattgcaaatttgtttggtcagaatgggtttgggagagaaaaacagcaaacagattacacatcactacgacgtgcttttcataatgtaaaaaataaagtcacctgtatggatgatcaagatggagggaagtcggtgctatccctacggataggatgtgggttggccggaggtaactgggatgttgtacaagaaattatagatgaggtatttgcagactatgaggtatccgtttataaatttaagtagtctcccctacctgcttaataaaaatgaaattacatccgatattgataatgttgtatgaatgtgaaattaaaagcattaaggaggttaaagttgatggaggtgtgtgaattgcaaccaaaaataactttaaaaaaggcacaagagttatttgatcaagcaacgaagtatttcacagtagatcacaacaatcaacccgaggagtttatatggtattcaaaaaaggatcaagagttcagactaagggagcttcgtaacggtgttgttccaaattcaattgttgtctttagtgctgaggagatgtttgatcaatcactgaggtatgtaaacaaagagcaaacgaaaaaagactcggtgaggtacatttatgacaagatcaatcaccggttaaatctaatgcaaaaaagaaattatttatccgaagtgaattagtacggtctgttatggggtttacataaacgatggggttgtgacggtgtatggatggtgtaatggttgtggaagtatctgataatatttactcggtttgtttagaggtgtttggaagtattcatgagttaagggcggaaatagacaatacagttaggagaaaaagtatgatggattaatcttgttagatactttattcattcaggtaatggggatgacaggttttatagtatccaagcggatcaaggcgaggttttatggagtacgttcaacatcagggtggttaaaaagagtgatggtgtaagaaagaaaatagctaaagttttgctacacatagagatttgattgtaaactcaacattaacttctgtacaaaagagaatgttgggtgcgggaattggaatataaaaactccttgccccctcccctctttcggattaggattgatttataagaaagagtacgggagggttttttctgtctaaagataatgtaatcgagtttaaaggaagaagtaataaagcggatagtttcctggatgacaggtatattgatttcttggatcactttttcatctataaggagtttttaagtgctacggacagattaggtatagaggttaatgttactgaaggttgtgttcaggttgtgtttcctcctgaactaaatgaagatagtgtaacagttactacgggcaaggaatttattgacttggtgcattatattctagttatggattggggtacatttttcaacgaaaaatgattgactccctattttatgctcgataattttttccatatcccccatctgtttatgtaataatataaaagatgtaaggttttagaagggagaaatgtcgaggatgaatcaaattaattctgcgagagtattcatcagctctacaggacaggaatctttagttgaattgcgccgcattgtagcggatcggttgtctggtgctggtcatttacctcttttgtttgaacataattttgggatgtggactaatgatttgttacgtgactgtttagctaaggttgatgaatctgatgtatttatcttatttatctccaataagtgtggatcttatacgcaggtagaccccaataaaacagttacgtatgcggaatactacagagcgagaaagggaaaaaagataatcataccgtttattgaggagcatatatttaagttctttttgaaccatattgccccacaattgcggcatcagattaattcttatgtaaaagagtatgatcgttatccggattctacatatactgttctgaaggattggtttcagcagttggagatttcaaaccctgtactttttgagcagattgaggaaacacgagtagatttatttaactgggcttttatttatgacgtgtacgttaatgagccttggacttatgttgttaaattggctaatgtggaaagagcatgtgaatttgttttagaatctttgagcggagttatccgaaaggctagtccttttttccaagattttgatggtattcaagaattattagttaatggtgatcagatgcgtgagtctttaagggcagcaaaccgatttcatgcttgtttaaaggatggaggattggatacactagaactacttgaggtgttaatgggttacatgaaaggaagagatgttccccactccaacagcccgttagatgaggatattgttaatcggttgtctgattgtgaagcgatttgtttgtacagacgtgatcaggattatttaaggctgcttgagtgtgtcgggatagtgatccaacttatgaatttatgatcaatgatgaaaattcatatgtagcagagacataccagcaaaacaacgatagtgttgagaacattttttataatgaagaaaagaaaaaattatatctcaccaaaaaacttggtgatttggttatatctttgcactatcgattactgcaggaagattggtcagaaaagcgtgttcagagttatgaaaaacaactattaactgctataatgaaagaaaggcgtcagtttgattttgcagctgatattctaggggtttattaaatgggaaaaaataaagcagtgtatattgggtcaactcctcagaatgtttcgagagaggcagaggaaactgaacttaaaaaattagaggcaaagagtaaagaaattcaaaacaatttaaagaagattaaaatggacaagggacaatttagctatacatgatttttgacaggttaacttgttagttgacttttattcgtggtaatatggggttagtaaagagtgcggcaacactctatcttttaaaaattatctttcctgatagtctttttttcacttggacactcatccgctcttttataaactggatgagtgtccttttattttcgatgaacataattattgatagtgtaaataatatcaatattgaaatcgataataatgtcaattgggttttcaatatcgaaaataacatcaaattttataatgaggtggtttaatgaaagactattacgaaattaaagaggtaagcaatcttgatactttaaataaccacataaaggacggctgggaaattattgagtcttatgctaatgaaggaaagattaagtaccatatagggttgacaaaggatactgttattgaaaatttacgtaagataatcaagttatatgaggataatgggttaaaagatgttctttttgatcgtatcggagatgaattaaatgatgatattaatgactatgaagaaacaacatatcaaccaagtttaaaccctctagtacagacatttaatttttatgaacgttgggtcaacggtaaagaaacaatgttaaaaaggaaagcaggaaaagagcgaaataatgatttagttgatcactctcttcccttttgaactgagataagttaatggatagcaatattaacattgatagtgataacaataatattggtaatgttattttaaagtcgaggagtgttttaggtatggagcgttatgtaattactttggttaaaggtagtgagagaaaaactgaaacctataatcttccggattcagttaaagaggtgtttaagcactgcaaggagaagtttgaaaaaggcggatggaaagttgaatctgttgatgaggaatcatattataaagcaaccaaaggaaagtaattattaatatcgattacaaattcaattgtaatattgattgtattagttaagtaagatgccggggagttcctcggcttttctgtaacttttatttgacaaatatataataatatagtataataaaattaacaaataaagagattagattggagataataaaatgatcgcaactgatattcttattaaattaaacacttgccagggaaagggagattatactgacacttattgtgtttatgctgctgattggtttccggtagggtatcttaatactaagtatagacaggtgaaagaaataattaaaaacaacttagaaaagaaatattgtgaaccgatggaggattttaaactgagatatataccgttaacggtgtttcataatggggaactaaaacctgaaaacattgttcaggcactattagacagagatcttattgaaccgttaaaaaatattaagggtgtatatgcggcaacagaaactttaaaaaaggagttggaagaaaacagaagacaaagacaattgaaatttattataagaacaaaccgggtcatgatgggttcctccaagtgggaacgactagagaataaaaataatgagggattaataaccttatctagcagtattgaaagatttgatagcatcggtaagagagttttagtgtaggatggtaataaactcgtcacagcgagtataaagaggcattaggctgtgagcgttccccagaagtggggaggttgcaacaaattaaggaggcatggggaaattgaataacgacttcaatgaactattattacggcaacttcaattaatgagatcatgtaacgatagtatagagcggaatataaaaattcagtgtgtcctattagttctacttggtgttgttggtttagggtttttcgcaatcatgttaatgttgattgtaaatgggtgactggggtttttacagactgggttacccgtgtatgtagtgattctataaataggtctttataaaattaattaaattatataaaattcgttggaaggcgggtcggttgagtgaagtttaaagatataaaacaatacataagaagcggtggttatgcatttgatgttggacttaggtatttacctgaaacaattaataattatattaatgaatatgggttggaattaaatccagattttcagagggggcatgtttggtcgcaggatcagcaagttaagtatctggagtatttgcttaggggaggtagatctgggatggacatatacttaaatcatcccaattggcacagtggtggagatggttggttcgtatgtgtagatgggttacagaggataacagcatgcttaaaatttataaataatgaaattaaagtatttggtcattattatagccagttcgaggatagagttcctctggggtttggtctgcgatttaatatcaatagtttaaaaactcgggcagaggtattggagtggtacatacagttaaatagtgggggaactattcatacagaggatgaaataaatagggttaggcgattattacttgatgaaaaggcttaatagttagctagtaacggctgaggatactacgagggatttagataataatattgattatactattgatatcaatagtataatcaatatggctttatacattcttgcgaggaggaatttaaaatgtttttactgcgagatactgactcaggaatagtttacaacgcacttaaaaatcctgctgcagtatttgattgtgaaagtggaacagtacataaaatcggtgagagagacaaaatgataaagtttcatgaagatatgaaatcaaagtataagcagtttgggtttgatgatattgctcaggatattaagtttatggatctgccgaaggatcaagaagaaattgataaggtatttaatatttgtgattatataaaaagactgtatcttaaaaaacaattacattaatgtaattgatagtgatgttaatattgatatttaaagatatgatgggcgggtgttaagtcaaatgagattaacatttagagacaaacttgccatattcaaactggcgaatactgcagagtctatcaggccgttaagcgccgacgaggtagtgcttttaaaagaaatttacaactcttgttctgatgaggaaaaaactaatattgaaaatgaagcggtatgcgttgtggagtatttatttagggactaataaacctggagacgtgagatttcacgtctttttgattgaggaagtaaaaaatgttgatgggttatttggtatcatatgtgtaagagatctggtgttagtgaggtgtaatggtgcaaatacatacaagcatgttagagggtaaaggtgaaggtgagtttcttccggaggatttttatttagatggtggtctttcacaaaaacaaatggatctgattgatgtcatattgaaagcaacacctaaaatgttaaaaaagcaggaagatattatacctaaatcagcagcagcactaaacagaaacagtgtgaagataacgttaaggttggcacaaatcataccggtgttgatgagctatgttaaccctcggctgtttattggggataagccgggtttggggaagactgtaatgtctgctgcttgctatagttattatagactcatgatgttaaaaaagggtttacccattaaaaaaatcttagttgttacagaaagcgtacacgtattggggtttggttcagagtggggtaattacgggattaaccttcttccgctcactaaatcaagtacaggtatagcgagagcgcttagaaatagcaatatggatgaatatgatggggtcattacgaactgggacggattaaaaacaaacgggtttctagattattatttacagcatgctgatgagtatgggtatgctgtgtttgacgagacaagcaaactgttaaaccctaagtctgttttatattcaactactgacaacattataaacaaatatcgtgggggaatacctcgggttatatttttaaacgggtcgagttttgaaaaaaatatcttcgatttttattatcagttttcaatattaaaaccgaagttgatcccaaataaaacatttcttgaaagccggtatgttgttagaggaggtcgtgagatttatacaaaagatttttctagattctcaccaaatcagcagcacgtcgtgaagagacaggtaggggaaattattgattataaaaatcaggctgaattacgggaaaggttaaagtactattatatagcccggagtaagagagactatacaaaagatcttcctgaacatagctatatccttcatggagttgagcttactgcagcacagaaaaaggttctaaatgaaaagaaaaacatctctttaataaacagccctaagacgtcagatccgaaagcgaagtttacggttcaaacatcacctaaacttaaagctgttttagagtttgctcaaaaggttgaagatgacagaccaatgatctacgtctataacaaggagtcgcagctcacgattaaaagtgaacttgaaaagatgggttatcgtacagagatactaaacggtgatgtaacggttagtgaaaaaacagacatcttaaaaaggttcaatagcggaaaactggatatgttggtatttaacgtagagaaggcaatgaatgtaccaacatccgatcgaatcattttttatgatatccccacaatgccgcagagaacgaatcaaattaagggtaggattgaccggaacaactacgacaaaaagaagttttatgatttcttctgttatcttgattctccggaaatgtccaatatcgttaggttggcgtactttagggaacaccatagtaatgagtttacaggtcaagtcgaaaatgtgtatggggcgcttgtggggcaattacaggttcattatagggaggactgtttagaagaggtcgaagagaagtttgcttggatggagaacaacaataaaacatatgaagatatacaggatgatgtagatgaaatactgggtctatcctgatggtggggtgagatgtaagtctcactccttttttatttgggtatgattgctgtaacaatcaaaatgagaaacgagtgttataagatgaggttaggttgttattaggtaaagttggatattaaaaattagcggaaataggtgagggggagattttatgaaattcaaggtaaagaaacaagtaatggttatcttctcagaaagagaggtgcgggggtacataaaaaatatagaggttaagggcagaagaaggttgtctgagttagaaaagagtattcaaaaagaggttttattgattcaaagaaaatacccaacagctaatgtgaagtggacaataggtgtagttgagcttcctgtatctgcaagtgcttagaggttgggtggttaggaaggggatttaatttgaaagagtttttaaggagtaaagccggaattgcaactttgactggagtatttggggttcttgttgctgttctggttgttattatttcggtaacgggttcacataaagcagaagcacaggtattaagcaaggcacagaaaacggtagatgcattgtttgctgatgatgaacataaagaactcgctgacgatatgaaccaagatagaattgacgctgcacgtaaggaagtaaaaaaggtaaaggatgaaaaagcacaaagccagcttacattagacattaacaatgctgaggatatgtataacacacaaatagaggcaattggtttagttgatggggttatagacagtgaaggcagattaaaagataatgttaatgaattagctataaaggatgcccgtaatgcagttgttggtgttactaaccttaaagtttatggggagttgtccgaccggttagataaagctgaaaagctgtataggcaacaggttaaaacaattgagagtgtccaaaagcttttcaaggatgaggagcataaagaattagcggacaaagtagataagaaaaagatcgaaaaggttaagaaggatgttaataaaattacgagtaaagctaaaaaagagcaattgttaaaagaagtgaagaaagcttctgatctactgaaaaagaaagaggagaagaagaaaaaagaagaagaagaaaagaaaaaacgtgaagaaaagaaaaaagccgaagagaaaaagaaagaagagttaaagaaaaaagaagaggctgagaataaagaaaaagaagaattgaaaaaacaacttgaagaaaagcaaaaagaattacagaaaaaagaggctgagttaaagaaacaaaaacaggttcaagaaaaacaagaggaacctagatcgagtgagtccaagaaaactaatcagtctgtaagtaaagcaggaaatacagtagcagacatggttccgggtttaaaaaataaaaacaaagcgataattgttacagataataagggaacaaaggctacagtatacttaatggagaaacgtaatggggtttggagtactgttgacaagtttgggtctattgtcggtaaagagggttttacccatcagtttagtgaaaactctacgggaacaccgattgggaatttttcagtagggattgcttttggtcgtaatggtaacccaggaacaaaattgacttggcataacataaagactggtgatgtgtggattgacgattctagcgacaaacgatataatacgttacagactggcgggaacggggaaaagatgaatatttcccagtatgattatggtttccaaattggttggaatctagatcggacgcctggtaaggggtctgcagtctttttccatgtatcaaacggaaagccaacattaggttgtgtttctgcaagtaaaggtaatgtaattaaaactcttaaatgggttgataaaaatacacgtattgttattgcaccacgtaatgaattaaaaaattattaattttagagacagcgtataagctgtctttttattatggttaggttgatagtaatcgaggtaacgagcgaaaggtattcgtgtacactatatatagttaagttattggggggtacgttatggcaagagattgtcgagtatgcggcggaaaagggttccgaatggagaagatcgatggatccctaagacgtgtagcctgtaaagagtgtgggggagtacgtaacttccgagataaattagaagcaagagagccatcagatagggagttggctgaatatataccgaatgcttattttagagcgattgagtttgatagagcggttttagaaaaagaaatccccgtacctatggcggtaagggacatatattttgaagtgtactatgactttatggagaaaatgatcgctacattacgaatgggtcaagtacctaaaaagagctatattgtcacagcaccagataactttgggaagaaggtgtttgtgtattctatgataaaaaacgctctaagggggaacttaaaacctacggagttaattgattctcgggatgtgtatgatcaacttgaccatcaaaattatgcccaattaaaggaatggtttaatgccgatattgcgtttatgacattgggtggtgcgccggctaagtcggatgcgatatcaatcaagactgttctggatatttgtgaacggaagggaataccgttaattgtgttgtctaggtttaacgggtcttattttacgaagtttgatagcttaatggctgcttcagtgggggtaaaagctacgaaggatggagattatggtcgactagagcagcaaggaatattcggggacacgttaaatgcagtcagggagtattacaatactcagcttggaggatccgttaaaaattataaagatgcacaaagaagagggtagaagtaggaggtaaagtatggcgttagtcattacggagcaggatatttttaaatatttggttccacatgaagatgttgatctaaatataaggtctaatactcgaataatgctgactcgtataccggttaacatattcaaggatgagtattatattttataccgggctttcgaggcagcgaacaagcacaatatttggatgggttatgagcaactacatcagatattgttgaataaccttgaggatataattgatgaccctaaagtgacactgtttgaagacgagcaactacctagaaatgaattaatggataaaatactggactatacactgcatgagtacgatgatttgtgctctttggatatcgaggatgtggataacttaaagggaaacatgcaattgtatatcgagacctgggcggttgagaaatcccgggagattactctaaataagctcgaaattttaaatgagggtaaaaaatttgggcgcattttttataagggggttgaggacgctcataactactaccaaaaggcttatgaggtagttagggcgcttttagaagcagatgcgggtaagctatctgagtcgattgatacgtcagtggacactgttgaggatattaatcggaaaatgcaggaggagactgttgcagaaccgattgcacacactggtgtagatcaaatcgacaaacagataacggcattttataaaggtgaaattgttgttattcaagcaggaactggtgtaggtaaaacacgtaaaactgtaaacatagcgtacaacgggttgaagcgtggaaaaaatgtactttatctgtccttagagcaaaaagctacacgtatatatccaatgtttttagcaaggcatattcttgagatgtatggtgatatagtcgagttaacggataaagatatcatccgaaaaacgtatagtatggtttatgagccgcagaaaactgctgcagagattgactttatccaaaatgaaaatattgggcggttaaagattgagggtcgttcgttaatggcgaatgatttatacaattatttagtacgtacatgggaagagggtttccattttgacattgtggttcttgactatctggggttattagaagttcaaggagggcgtcgttacgatgtgttaaccgaaacaattaacatgataaagtcggaggttaaatcctttaagggtaggggcttcttggcgattatacctaaccagttatccggtgaggctgaggatcagttggaaaaaggggaatacgatttattgaaaaaaggtggaagtgaaacaaagtatgtcagtagggcggcagattatgtgtacactttataccaaaatgatcgtatgaaaaaggatagtgtaatgagaattcttaatagtaaggttcgtttagggcaagcaccgcagccattttatatggctgatgttgatttgggtaaatgtgtgtttgttggacgaccagaggatgaagatgatgacgatgatctctaataagttggggtgtagtaaatggctgtagataagggacaattggagaaagctagggaaattctaattcaagagattccgctctcaaagtacattagagataatcggttagggaatgcagataatgaatcaggaaagattaattgtcctgttcatgacgatagttccccatctttttactacgatgataaccttaaaacgtgtaactgtttcgggtgtagtgttaagggttccgttgttgaattacactacgccattaagaggaagacagatgatcggtatacacaagttaaggcagtcagggacttatctttaaaatacaaggtaaagctgccaagtttatatgagcgtagtgtcgatgcaaaaccgaaacatcaacttagaccttctaaaagaagaaggcattcagatttgaacgacgaggtgatgtataaacggaagatagaaaagttagagtatcagataaagtttatagaagatgtggacactaaattaaagttatataaaataatcgatgatatgtgggaaggcaaaaaaccgtctaaaaacgtatatgagacattaaacaaccgaatcaaaaatcttagttagtggtgtagttggagggaaaatgaatgaaggacgtgagacattactatgaaataacggatcggaagaaccaacaaaaaacggttaagaggaagtctccggttttaaagagtgagattgaggaaccctgttatttatttttagatcagtcaacaagttctggttatgctgtgttcgacaataaatctcggttggtgttatcgggtgttgtacaaaaaggaaaatcctctttgcaggaatataaatatgggtttcgagatcttatacaagaattggtggatagttatggggtttcgactgtatttcatgaagaggtttatgatgccagtaacatgataacaactgaggtacttttctacataaaacatatgattcaggatattggatatttttctgagaaaatagaagttctaggcttagaccatatgaagtggaagtctgagttggctaagcccgggaaattcaataagtctggggatcacaaaaaacaagttaaggaacttgttgaaaaagtgtacccactggttgctctaactgcagaggatgaggttgatgctataggtatgggtgtttccgtccttattaaacaaaaaaggagagtaaacttttaccataccacaaggtataataaaaagctgccactgaatgagtttattttaaaggatgatttaattgaaggcagtgagaaagatacaattaaaaaactaagaaaaccattccgggatgcttatgaaattggtgggctgcatgaacttcctttagatacacgaagaaaagtggatgatctgtttcgccggtttctgtcgcatagggatgccgtggtttatattcgaatccccaaaacgtataaatactggggagtgtatttgcttcaccacaatataagcccgcaggatctgattcaagatgatcaatcgtttatccttatgtgtagccgaaaatcccgtttaaaatagatatttttatagagtgaaagtcgactaatcaacatatgtgggctttcactttttttgtgttgaaatttattcaatagccttatataaagggggctatttttaaatgactattaataatattaaagatgatattaacattgttgaggatattgatcaggatgacatttctttagaagaaatactggcacagtattcaggtgataatgctgcggatgatagtggcattgagcaaaaaacaaacggtgaaggtaatgatggtcacaatgttgatattgaaaataatagtaaagaggacaattctaaaaacgtagcggatgatgaacatcttgatgagtttagtaaaagcgaatctgacataacaaattcgaatggtgcagacagctatatcgaaaaacccatggttaataacccggacaataatgttgataatgaatttaataatgaacttgaatatgaagaggatggtgaaattgatgatgataataaattagatataactgaacgtgcaaaaaggattaaagaagctttggaggagccagaagtcgttaaaacgaatttaactgcaagtttagaggacagtgagggtaaccctattgagccaagaaaacggggaacattggctgtccaagtaattagtattgaaaatgacttaaagcaaacaaaccgggtgcgtgtgggtgaccaggatgtttatgatctgcaggagtcaattaatagatttggtttaattgaacctattcatgtggtgccatttggtgattattatttgctgctgaatggttatcgcaggttggaggcgtgtgtcaaccttgggtatacggaagtcccagcgttggtagatgggacaataccccaacaatggttaagtattatgaggctattttaaataatgtaaagccttatcggttctcagagaaattaaaacatggtaagcacatccgagatacacagaaaaacgtttcttatgcagctattgaagggatactggggttaaaggctggagagttcttaaaagctttatatattgatcaaatgaaaaatgattttcctgacgtctataaacaggttgagttggggaagatgactattgagcagggttttaaaaaggttgaaaaagaggttgagaaaattgaaaaagaagctgctgcagttgatcaattaaatagtggtgaactagatgaaaagttacgagacaaagatgagttggctgatttgcagattgaaaagcaaaaacaaactgtaggggatagaaaggtattggatccggttattcggaggtcggttgaaacccgggatgggggttattgtcagtgttgtggatttggtaagggtgagcctgattttatgggagtatttaatgtgcaccatattattcccgtacaatatggtgggtctgatagtaaatctaatttgattttgttatgccacaattgccacaagttggttcacgactatgagtctggacggtttacgcctgagcagtctacttttgatcgaagaaatgatgtaaaacgaatcgtagtattgggtaatatgcttttacgtatgagaaaagaggcattacatgtattaagaacaaaacataaagaggtatcgagacaggtcgataaaggtgtactatctgtcggtaaagggttgttaaaggctaaggtagatcttaaaggtgaggagaagtttggggagtcgccgtactccacgtttaaagatgccacaatggacttagatcttggtgggtctgtaaagggagacttgggggatatgtatttagataatgaggaagataatgcagaaaacgatagtgtgttagagaataaagtaatgtgataaataggtctgttattaaacagacctatttttgggtggcaatttttgtactgatatagaacaacaatatgaatagttcattatgtgaaataccgttgacatacataggtaaaaagacttacaattgtaaatgtgaatttagtccctattttaatagaatatgggttacttatatttttgttggattggatagcgaaggataccacgggttgcttctgtttttgtatactaacatcagataggaatgtaaaaatgaccggaggggggttcatttggttaaggttaaaacaggtgatgtcttagtaatgcaaagaggcaacacatatcatgagtggttaatacgagatatcgctagacgtagaggatatccaattaaaatggtcaaagaggatatcaaagaggttaagccgtataggtatggcacattaactgctggaagagaaattgtttggataaagattgataaaaagccggcaattctagcggaaatagaaaaaatgaatgtgacgaaaaggatcgtagttcttgaggtatcagggaaggaaataagaacaagaattaaaaagttcccggcaaaaaaatttagggttattaacatgccttttataaagacatatgaagataagcgagggacacttgaacggatcgtatctaggtggaaaccagaatttgagtcaagcgaggtcgagaagggattaattcgtcttatgattcaaaatgaggaaacgtgggacgacgttcgtctttcaattgaaattgcgaataggcaaggtaaggttattacaaaaaaatctttagaggaaatgttcccggaagcggagttttataagttagatgattggatagataagctgctgaaagggcagcttaaacagaaatcattaaagatggctgaatactttataaatgttaagggttattctgtagcctggttaatgaacaagattagagagcaagcaaatgagattagtttagtttatcaagcgtataaaagaggcattttatatgttccgtccagtcagtcaaaaatacaagagagactggatgttgtaaattggagtcaaggaacagctcttttggagttgagtaagagggatcaggggagatacctcgaatttgtgcaatcagtagattatagatattttgtaagggtattggcggtgttatacagcgccgatgaattcgttaaatcagcgggtgatttatatagagtattggaggaaatccgtctggtaaggagcgaatttgagtagatggcaagtgtagcagtggtgtcgggtgacttaattgtagcgaatggtactgtagtggtggcgaatgggattattagaaacaatcctttttcatcaaagattgtaatgagtgaagcaacacagtggatgattaggaatgaagatgtagtaaagaaaagtatttggtattggttccgacactgtaaagttagtggtggaaatgtagatgattgctttgaatatggattaaattattttattgagaaaaagaaaagagctttccggaaattttattttggaaaagagtcttcttatggaattgaaaattatgttttatccagtattcgcaatgttgtgcaagagtatagatctaggatgaatgatggccataaggtagtaccattcgtaacaagtgaggaaacagatcaatttggagctgcagtaggtaaggtagaggaaactgtaggtagcgacacaattgttgaaacaggagagatggttgtagagtctgatgaaaagtactgggatgaacgattcgaatggttagcggttagttttcagcaatttgttgaggatcgtcagtacaaggcattttctgtggaggactacctgtactacatgtttttacgtgtagatactgctgatattgaaaagcacagagatattgttgctaagaaatgtggggagtcaaaagatctaattaagatggtaacaagagactttcaaatggaagttagagatggtaaagagtacgctgcagagatgttggtactcattaaagagttattggatggagttcaagcggggtggaaaccgctacatattcgtgagggagtgagtatgttgaatggcgactgagaccggtttttttgacggtttaggggtgatcggttggtttggtgtacttctatgggtagcttttattcttgctattgtgtttaagccgaaatggttttttagctattatgatagagtacctaaactgaacgcatttgacgaatggatgtatactcctgaacgtatttttgggtttatggcggtaaggtttatcgctatggtgattattgtaatagtgataggtaaagtaatgtttttattttaggcggcgtaagccgtcttttttgtgggggtgaggctattgtcgggtttagttggggcgtgtgttagtgcggcgtttattgtttttgttttggggggattatgcttgttaggttattttgttaatcaggatccagataaagcaaggtggtataaacggattggtatcggattactggtactatcggtggtcggggttgcttcgacttttatatttttacttgattcatagagtttacctaggaataatcttttctgataaaatgtgataaggtgctaaacaaaaagtggatactgaatatgatacaatgttttagaagttaagatagtgggggaagaactgttggtgataaacacctaacagttttttgatgattgaaagtttacaattatccacatagatattttcacaaggagagggtttaggatgtttgctatttattttgactataaggatttaggtcagaatataatgttaggggttattgtttatgaggatatggacaaaattatacaggaaacaaaaacaattaaaaaatcggggaaaacgaattttgaccatacactagaagcttgggtctatgctacggaattagtaaaagaagagggattcgatgatattaagtttctaaatcaaaataaactcatatttgattggcttgctaagggaaattacaccgaggagcgggctgtatattacgaccaaattaaaaagaatatgatgtatatgaaggctgatggtgcgaatgcgcttgagtatgaggttattaagggagataaaaacgaagctaaaaaatacctcaaaaaagcagtaactactgaatcacatgcaatcaagggagactttatggatgttttatttagtcaagctcgggatgcgaaagtagttccaattaaaaaacgtaagcgggcgtaatacggggagaagattaatggtaaaggtaacgttgattgctagagatatagagaaggaaaaagaggttgagtttattcttcttcaaatgaagaagctaaaataggaggtaacaatggggatgtatagaggaagaactcgggttcgaagataactaagtgagtaaaattttaaccgaagggtttagtcgaggaggttggtattaattgcagcctctttttattttgtttaaagtgcggtttatcgtttgtgtgattcacagcgtaataaattaccgcagaagtgatgttatggtatagctgtaaaaagagtttatagtgagggagtataggagtggttttattgattaaggtgttagacaaagtgcttgtaaccaatccagatcaattaaactatctggaggttggggttgtagttgaccgtgagttaggcggtgatgagattaaagtaagatttaataaagaaactgaggtttggtataaggaatccgatgttaagttcattgagcatttggggtacccggataatttgattggaggaggggttaaggtcggtgaccaagtgcagggttggttttttggtaaaacaggggttagatcgaagtggtatacagtaacaaaagtggatggggatacggttcggggtacgactttgggtagttctgatgaggttgaggttgaaaacatttttcaagtccagaaatgttcagataaaaacgacgatgactgttttgtaaactatataccaggagagtagcagcacaaggaaagcagatagggttgtttaaagattagtgttttaggtgagatattaaattttcgggattgaggggaatacaggtgaaaaaacgaaagggtaaaaaaagagcatcgttgggtgctgggttacttcttgtagctggatatttactttttggtgggaacacagatgttgatcatctaattgaccgggttaaatctgttgttggggtaagcggtaaggttcaaacaacggaaaacacggatattgatcagtaccgggttggggacaaagttgatgtagagatggttaagcatgttgatggtgatacaacaaaagtaaaattaaacggtaaagaatatacggttaggtacttgcttattgatacaccagaaaccaagcaccctaaactcggagtgcagccgtatgggaaagaagcgtccagcaggactaaagagttgttgtctaagggtcacatacagatagagttcgatagcggtaataggacagacaagtatgggagattgttggcttatgtgtatgctgatggggtttctgttcaggaaacgttattaaaagagggtcttgcaagggtagcatatgtgtacaacaaaaaggctatgcatttaaacgagtttgaggaagatgagcaagaagcgaaacaaagagggttaaatatttggagcaaaccaggttatgtaacagataagggatttaatagtcggaattagggggatagggttatgattatatgttctatagaagcaattgatggggcgggtaaaacaactgtattcgagcgtttaaaagaggatagagacattaatgatggtagtttacatattgagtatgctaggtttccaacagatgatttttaccaaatgtataagcggttaaacaagccaagtggagatgtgtttttaaatttgcataatgaggataagagatctcttgttaagagtgcaagaagtcgtggagtcgatttgttgatttgcgatagaggagatgttacacaaaccgtctataatggtcaatgtagtaaagataccatgtacagcgatttagtcattttcttaaaaacgagtgttgaaactgcgatgaaaaggatagcgcatcggggaagtgaagatatatatggttttgagacagaggataagttaaagcacattgcaaataggtatttaagggtgttaaatcggttagattatcgtggaagatacgtagaggtagtaacagataacaaaacgcctacagaggtttacaaagaggtcaaaggttatgttatttcatttttatcaaggaaatatgcaattataggcaaagaatgattggggaatttcattccgatacgtgttaaaagaacggggtagctattatgtgctaccttttatttattagatcgggaggggattagagtgtcaggtaaggtggagataacaggagaaggtcaatggcgtaagggtataggaagatattttatattgcagtaccaagtagagactacaaagagagacgaagaggttgaggagatttatttctctaacatcacaaaacataattgcaaaacaatcgaggaagtattcaatgtagtaaaccggtggcagtcactggggtggaagaacattagtgtcacgactcaggttgtcgatcgaaagggggacgttgttattgaggagaatgtgttagggattgattggcttgaaaatgaacaattgtcggcagaacgatgggaacttaatgaaactgttcaaagacaagaaaaagagttgaacttatacaggaactttataaaacagtataattcggaaaggctgttcgatgagtttaagtgtgggcaggggacattgtattggtatgaatacaggttgcgtgggtttagtttagggtgtcagcctgatggtcatgtaagggttgatcataatcggggtaggtttggtgctgtagcgtatagtaagcctttaacggagcaacaaattagagattacgagcttttgcctatatcgggtaactaattaatttgggaggaatataatgaaacttgaaaagactgaaccatgtaaagattgtccgtttataaaggggagttcgactaatgttaccctttcaagggaaagaattcagggaatagtagatggtatacggtataacgattgttcttttacttgtcataaaactttagatttatctaaaaataagcagcagcattgtgctggcgcaatgatatttttatggaaggataataatcctaatcaaataatgaggatatatggaaggttgggtatgtttgatccagataagttaaatatgaatgctgatattatagatgattattgaggggagtttagatgctcccttttttatttgacatttacattcataaatagtatagtaattttaacaaaaataatatgtaaggaagtgttttgtatgtcagaaccaaaggtcattaagtgtgaggaatgtaataaaaaggtggagttacttagttcatgggctaatcaatgttcatgtggaacagaatataacgggtttggtcaaagattagcggatagatctcagtggggatatgagacaggggaaactttttaaataggggttcattcttttgaataaactgcaagttcaatactgtttagagtcggagatgttgtggggggagaagtttgattcttgaaaaggtaacttcaaaaatatacagaggtttggagaggaatttgtttgaaataaccccagagggagaaaagaaattttggcacgaggaaaaggatgagtatacccctgactgggtagttagggtactggaggattcaactattaatcattatacatctgatttttggagtccgatcaatttgggaaaatttaaacatgtattgctaacgaggaataaagatttcgaatttagggtttttgaatttggagtactgcgtgttacaaagaataggtgaagtattatagcatttagggggaagatggatgaaaacagatataaatagcagcttaatgatattaaagtcagagcgtgatagcgcagcgttaaagctgaaggatctaatagatagtaccaaacatactttgaacaggttagagtctaagctaaagagtaataagcggttgtatgattcagatagccttcaaggtatgggaggggaaattgatatttatataggtaaattggtttcttatgaacgggctattgagaggctaaaagagcatgtagatacggattcaggtatataatacgagatttgttgagggagattaaaattgatctcccttttttatttgacaaaataataataaaatagtataataaatttaatagaaaataacataatccattggaggtaagtgtattggctgcaaatatggatgatactcgggttattagtgagtgtgtagacaggaatggtacaaagcatcaagagattgatacaaagtgcgatagatgcggaggggctgggaaatcagataaatggatgtttacagggaaggtttgttataagtgtggcggttctggacgaatgagatgtaaacgtaaaatttatacaccagagcatgaggagaagcttcgaaaaagaagagaacgtgcagcggagagaaaaagggaaaaggctattgtggaatccaaactcagaaatgaagagctatttaaaaaatggggatatgaaaacggaaagatttatgcggtattggggagcacatataacatccgagaagaattaaaagaggaaggtgcgatttggggagatcagacaatcgggtggtacttttcaacaaaaccggagaagtgggaaacagttgagttggatgttagtgagttggtttggtacaacgatctcggtgaggttcaccaaaaggggtgcttggagtacaaagactatgtcaataaacaaaaaaggcttaatgaacctcctagtgaatgggtaggaagagtgggggataaagtagatctagtattgagagtggtcgattcgttttatgtaaattactacaacccatttgcttacgggacgtcgactgtctgtataaataagttgagggatggggacgggaatatttttatttggaaaacatcaaaaaatctaagtaaccaatgtgatggtgagggaaaggttaggattcggggaacaattaaagaacataatacataccaggatcaaaaacaaacagtgcttactcgctgtcgagtaggtaaacagggggaataaaggtgaaggtaacgatacttgagtactcaagagagcacgcttatgtgagaatagagaagggcggaagagaatggactacattttgggctaaggcatttgatgataaagggaatgtaataagcccacggttaaacaggttaaggctgcttttagggaagatcctgcatcatttaaataaaagttatggttaggttcaagtatatatatggattctgaaaatgatgtgaatgggggtatccaaatggataaaaaagatgtagctcaggtcttacaaaagaattatgattacttccttaatcaaaaaagggagtcatgttccgaacatgagcaaagagaatatggaattagggcgaatacagtttggattttatcgcagcagttaggggtaagattaaaaacggaatagtggtttagagttcgttgattaatgaaatagaattaaaaattagtatgcagcttaaatggggtacgtcctgtttaagctttttcattatctggatacaaattatagaagttcatataaagattaagagtataattgattataaaaatgaaaagaaaaattttcaagataagtcggaggtagggtcatgagtgaaggtgtgaaggaagaacagggcgtaagtatttatcatgatgtcaatgagtataggaaactcattgggtgttccgaatctgttgcgcgagagagatgtgaatattttagagggttgcagaaaaaagctgaacattgtaagtgtcctaatgatgattgtcagttagatgcaaatgaatgcttaattatcgctttgggtgaaagtagtcaggggtcttgggtttattgtcaagagtgcgaaaaaacctttgatttaggggacaaacgaattgaggattgggttaattgtgaaatggtttttgatgaagttcttaggttgtcgctagacttaacgttagaggagagggtggaatgtgtaggtggtgattggaatgaatttgtttcaaaatccacgtccgaattattgatgaaatgagaggttggtcagttatggacagggagaagattattgctattattaaagatgagtcagagaagttaggtttagattatgagatggttatgtcttggctgtctgagttaaactttgaactagatgtcgttgttggaaacccgctatttgatggatctaaggttaaaactgcagtcgaaatggcgtaccgtgtttttgcgtagtttggggtgtattatggtgtcaataaatatagttgtgtgtatgttggctgcattggggttaattttcttttatgctatctgtattttcggtaggtggaaggttttccagataggatcaccaatagtgtttgcgttacccgtattatttgttgggtttgctgcagtggagtatgtaataacaccagcattaatatgggtaatgactaaaatagtggataacgtttaggggtgttgttgatgtataagtttttagctgattggaagggggtagtagttgactacaacccaacttatcggaaaagaaaagacaccgggattcaatatatgttgaagaaaatcgccgaaacacaaaagtttgctaatgggatgttcaataaaccggtgacgctgtttgtataccaaaaaattaatggtgcatacaaagaaattgaggttatagaggttccggaaacaatggaactataatgggtatgattatgaatatgttgtttttaaaagtaagcgatgtaatgggattactcaatagagataagatagtataattattgtagaacttgagtaggagggatacatatggcggttaaggtgacagaggacgaaatatttcaaatagagacggaaaagagatttggtgagtttctcgttaaaagggtaaatgctagtaatttggatgtttatcatagtgatgtgatagtttttcaaggggaagactacgaggtagcagaatacattaatcaacaatgactgcgaagaaggcattagccttctttttttatgattaaaattcttcacaggcatctgtttgtgtgtgataacatgtaggtgatataaggttggataactgaggtaaaaaatgaatttaaaataagtgttatgctttcgtaagaggaaaagttttaaagagggtgtgaaataaatgtatgcattgttaggtggggagaagccaaagagaaaagtctctgcgcgaataaaagtgggggatttggacattcaatatgttgcagcatctactagggagcatattattggttcagtaaacggtgaagtagtgggaagtatttatatttccgcaagggttgttaaagatctcgatatgaaagtggagaaggttcaggtagccgggagtcgttgggaggacttgcggtttgtggcggggttactaccggatgaggagcctgttccagagcatacaattgagtgggacaaatccccgaagggaaatacaaataaaattaaatcgttggagtaccgtgacttagcaaatgcggggtctgtatccgcagccaagcttaatggcgggattgaagattatttatatgaaaatgttccaattgaagaattaaaggagcagtttgatttatcctgggctgatgataaggattatcgtattttaatagaagatgatgagatacatgaatgggtagaggggttagctcaaactgacgatatcgtgggtttcgatactgagacaactggtttattggtaaacagaacaaaaagggataagctagttggtatttcaatgagttatgaagatcatactggggtgtactttccgatcgctcatgagcggtacgagaacgtccgtatggggacgaaaaagcttctggatttattgaaaccgtattgtgatcgtggaagtaaaaaagctaagaaacttgtaacacacaatggtgggtatgattggcgggtaatgaagatgtacgattgggacttaaatattgtgtacgatacatttattcgtcagggtttatcggctatatcagaggctaaatatattcggaaactaaaagatattacccgaaaagttttgggatacgatgttgttgagttagaggatatgtatagacctagaactaaacaagaaattgcagcggttaaggatgcagtttttgttggcggtgcttcggttaatgaaattactcggttcaagctagaaactgcggaaaagcaatcagatttaatggatttccggtatgcttctagggatttctcagaactttacggttcagccgatgcggattttccaaggttactacataaaattatggataaagagtgggataagtctcttgatttaatatatcgggcagagattgagttgataccggtattaggtgagcaagagtattatggtattcatgcaaagcgtgaagattttgacgtattgcatgaaaaggcacttaaacgaatggaagagttggaggaattgatttataaggaagccggaagacggtttaacataggttcttctcaacaaaaggcggaagttctatttgatcacttaaaattgccgttcttacctcgatttaaaacgaaaaaaggtgggcgttctacagataaaaaggtaatggaaacgttggagcaatataaggatagtaaggggaacaccaagtaccctatcatacctttaatgcgggaatatacaaaactccaaacgttggttaataacttctatagcaagctgccaaaacggattgtagataactttattttttctagttacaatcagttgggaacagaaacagggcggttaagtaatagtcagccgaacctacaacaaacagaaccagtttctcgggcgtatatgactccggattcggatgattattatttcatgatttgtgactattctcaggttgagtatcgtattatggctggtctaagtggtgaggataaggttacaagtttcttcgctgctaacaaagaagcagattatcatatcctggcttacgcaaatatgatgaacaaggcgtatgaggacgtaacatctgctgaacgtaaaacaggtaaagtgcttaacttcggtacttcttatggcttagaggatgagaacttggcgctcaatctttatggggatacaacaccgtttcaccaaaaaatggctagggaagcacgcaaaaagtatttcgatggcgtacctaaacttagagattattttgagtcggttcgggatgaggcagagagagttgggtatgcaaaaaccctgtttggtcgtaagagaattattcatgagtttgcgtatagtcgaggaagagtttctgaatataagaggggttctggtcgccgtaaagcgggtaatatgccggttcaggggacagctgcagacatcatgaagtttgcaatggtgcgtgtacgtaatttgttcagaaaatacgggcacacagaggaagaagcaagattggtactaaacgttcacgatgaaatggttatgcaggtacacaaaaagttgaatccttggtatgtgtgcatgcttatgagggaagcaatggaaatggatctttctaagtatggattcccacctctctacattggagcaaacgtggggtattgctggaaagacggtaaagccgatgaattagaggcgcctgtaatcttaatggatgagaaaattgcagaagtaaaagaaatgatggatcgtggtgaggagttacctacgtatgatgatccaagaaaaatgtgggcggatgagatcacaaaattcgcactcagggtgattaaagaagagatccaaaaagatgaggttaagggtctggagaaagctcatgaaaatggtcgtttggttaaatatagccaccacttcggttctgcatctgaggcgataattaaagagttaattgtatctacaccagaaaaggtgtttaaacgcttagacaaggtgcaagaatttaggtctaagctggcctataagcacatggataaactcaatgagatcattacctctaagggtgttaaagcgtatgaggatgccgctgcgagagatgatattagacgtattgcaaggtatttcggtaagtactcaggtaatgttgtgaagtggttaattgaggatggtattgattctgtatttggtacagttcatgagcgaattaaagaagatggttttaaagctgaggaacttaaaaagccggcaccaaagaaaacgggtgttgagttagaggaagaaaaagaaacggttattagcaaagcgaaatctatgctgaaatataacaaaaaaaccaaccatgttcggcttatcatggaagagaatgatactgagttgtttagtctaattgataaaatgttaattcctcagcagaataaaaaactgttcagggatgacttaaaatttgttacgtttgaattggtgtatgcgtctggagattcctataaacgaagtggttggttatggatagcaaacttcttgccgattatgagggatatgctgattacacatttaacaggaggaagttatgcgcagtatgctgatcggatcgagaagatgggttcaaccttcgttaaaactgaggaacagattaaaagggaagaagagaggggtatagacacaaaaccaatgtctaaagcggagcttaaacgaagacaaagagaatttgcgaagttaactaattgatggcggagctgcggctccccttttttttattaatgaaatacgtaatctttacaaaaatatataattaatatataataaatttaactgtattaattatggggtgattagtagcgattgtaaatttgctattaatgataaagttaagcccttaaacaaaacggcgggaagtcgggattttacaaatagtgctacattttacaagatgtttgagttagctcaggattttttgtatgtggtaagagtgaatgtgggggagtctgagagggttggtgaaccgtgttattggtgtggggttcatccaaaggctccaatggatacatacagagagtcggatttagttaagtatgaagtttaaaaacacaacaatgtttggggggaactttaagatgggttatgaaaaagaaaatgaagtaacgttgcaaaagctggtggaggaggttaatgagtttgcggaatatctagttgaggttccggggcatcctggaattaactataaattcccgaatttgtatggggcgtcagttatacaaacaaggggttggattgagttagctgtggtatggtttggtcacagtatagaaggtttgccgggaggacttattatgtacgatacaccagttgtagaacatgaggttgaggtcgtagaaaacagtgaggggttaggaaaattgcttactgagatatataatcttccgaaaagagaagatagttgactagtggggaaaatctgaattaaagacaatgggaaagcaaggttaacaataaggctgggggaaggtaaagtgaggattacaaaaataccgttagattggttttaccgtaaggatcccgattgggttaaatatagggagggttttcagcaatacggatatgaagaagtagttattgatagcagatctgaatatcggagaactggtggtcgggttttatcaatatataacaaaaaagtaaagagtccgtcattaggaaagattgcagctaacgctcaggttatgttattggagtcactcaaagatagtgatgatattgctgtgttgttggagatcaatatatttgagggaataattaaagacatagtgggaagtttggataaggttccaatcattattccgatatttccggtggatatagaggaggtggagttggaggcttgtgattggttagcagaagcggcactggaacgggtgttgaatgattatagaagtattgacgattaaaggtatatgggagtgtgtagttaatgggtacaaaacagaagttttatacggtggttgttttaggtgaaaataaaaaatgggttgtaaaggcagatagtgaggaatcagttattgaggcttttgtacggtggggctatgcatcgtctggcgaggatgaggttaagattgtacatacgtcaagttcgttgaagaaaacaatgattagtagtgggtttaaggttgtaacattaaaagatgtgcgatccggtaaggccagagatatgtgggtagatgcaaatgatttaaaactgagagcctaaataggctctcggatttatttctaaagatgggtgttgttattacatacccatttgttgttgagcgagtctgactaatcgttttgtaatttcaccaccaacagatccattggcgcgtgatgtcgtttctgcacctaaattaactccaaattcattggctatttcaattttcatttgttcaattgctgattcagcgttaggtacaagaagttcatttcggttgtttgacatagtagcagctcctttatgtagtatagtttacttgtatagcttgtgcgaaataacaaaacctatacggaatatatgtgaaatcagaagtttttcaccacaataaaattggtgtatattttttaagggatatgtattgtataaaagttaattaactagaagcaattaaggttagaggtgtggagtaatggatgtaagaagcgataaagaaaaaataaaaaaattagagttgctgatggatcagaatccaaattggacggttgggggattagttaaagagataggtgagtcaccaagatgggtgagagctaaaattaaggggatagagttagctaaaaaaataaaaaagaaactggaggacaatccagatatcactgtgagtatgattgcagaggagctggatgtatttccggctcaggtataccatcaaatacagttacatggtatggattacagtgaacgaaaacacacaaaaataaacgaccgggtagtagaaaacttaaaaacgttagttagcaagcatccagattggacggttagtcagttgagtaaagaactggatgttagcgcaacttcggtttggcatattattaaggacaacaatattgaatatacgccgaaagttattaaaaataaggtggatgtggaaaaattaaaagaggaaattaaaagcaaccctcaatggagtgtaaaacaactagccgaaaaattgggtgtgtctgaaaatactattagaagaaaaattgagaaatacaatattgaatatacgccgaaagttattaaaaataaggtggatgtggaaaaattaaaagaggaaattaaaaacaaccctaaatggactgtaaaacaactagctgaaaaattcggagtggctgaaaatactatcagaagaaatattgaaaaacacaatatagtaagggattagtgagaggttgtggattatgtgccacaacctcttattttgattgcggggttgaccgcaaaaagggtgactttagataagatagaggggtaataaagttaaggaaatagggtgatgttaggtatgctaataaaaaagagaatagctaaattaagcactagaggggtttacatacaggatcagcagttatcggatacagattttagtccgggaactaaatataaatatcaggtggatattaagaaaaggcaacttttaattgttccgtctattgaagatgggaatacagtatctagaagaaaacttaaaacagggattaagccggtaatagacattagaaataaagaggcgctttccgtatttgatggtatggatgctctagagatagagatttttcaggataaggtaaagataacagggatacaaaaagaaaagattaaattaggcttgtacgataaggtaaagtcaaccgcttcaaaaatatttcagtttagaaggataggaagttctgaatcctcggttcttattaaccgtagagatttaaaaagggtcgttggggacgttagtgagtttgtaccgcgaaactacggtcacgtaatcccggggtatgaagatgcggtacgggcaattagtttatttagtggggcaggaatccttgatcaagggttcattgaagaggggtttaaggttgttttagctattgagaaaaatccagatgcagttgaaacatacaggcataatcatggggatcatattgtagaggcagacattaaaaagttcaattttttaaagctatgggaatataaagcagagttgatgtttggaggaagtccgtgtcagggtttatccccggagaaccgctatacaaatttcttagacaaccctaacaatgaattaatcaattattttatagaaggggtaaagtcaaatccatattgcaaagtgtttgtattggagaatgtacctcaaattttaacagcgggtaatgggaagtttaaagatgagatctacagcaagttatcagattttgaaattacgtctggggttataaactcggcagggatgggggatccgcagatcagaaaaagagcgatatttatagggtctaaaataggtaagattgatttacctaaagagcatataagtgaggatcggtatgttacggtacgtgaggcgtttagggggttgaacgacagggtaccaaaccagttggatatcacaaaatctaggaaagatacattaactaagatgagttttgtaccgcctgggggcaactggaggaacatcccggatagcttaaaaacatcgaaaatgttaagtaaaaatggagtacatagtgatatctataagcggttggagtgggataaaccttctataacaatcacgaatgtaaggaaaacactattactgcaccctatgtttaatcgaattttgagtgttagagaatgtgcgagattgtttagtttaccggatacgtttaaattttttggaagtctggggagtaaacaacagcaacttgcaaatgctgtacctgttaagttggctaagagcgtagccaaagcagttatgaacaagttcaaaagaacatactctaaggggtcagtggttccaatttattgataggggaaggctgaaatgaaagaggacaaacaagagttacttgagacagtgaaagaagagttagcgggtatggagtactgggagattcaaaaatttttagttgcggctctattttataaggaagggatagaggatccgggttttgttttagttttgtctaatgaaagatttttggagatggcaagaggtgttgaaaagttatgaagaaattataagagaccttttgaggtctcttatttaaaattatcccttacagcttttgtgagaagttgtatacatcgatctatttctgcttttaaacgacgtttatatttcttagctgcttcataatcctcaaattggtatagaacaacctcctgaagcttggtgccttcttttttcacctttatttgttttaagattccatcatccattaacgaatgtagtgcccggtaaatttcggcgtgtgttggcgcataacctaagtgtttaaattcctctcttaatgtatctctcagttgcatgccgtacagtcgattttcttcggtcatagtgatcatatagagctttaagaaggctctttgtttgaggagaaaccctgtgtcttttcggttatcttgctcgttcatctcgtttctcatagtccacctctttttttattttattcgcttggatcattgtactaaaagaagatgtgtaagtccaaaaaactgataacggtctatgtttacatttatataattattatgtataataaaaatatggaaaatataagggaggtaaatgaatgttgggggttcatgggtttgtggagaagttaagtaatattaataaagaggtcgattatttatataaaactgattgtgttcagttgttatccgaattggctgcggttgaggatgaggtaaaaaggcttaaattaaatttatttctaaagagcaatgggggtttatccggaaaagagttacttgagggattggtcagagtattggggatagatgggaaaccgagtataagaaggttaaaaatatggaatccgtcaggagttaaaggtttccggttatgtgaaacgataggtgtatacgattatatggtttgtgattggagttgttatggaaataagttttcatggcaagaaaaacatcatgtatcaaaaaatcaaggatctgtacagattgaggaaacgtttgcgtatttggggcaagacgagttaaaggtaagtaatgcaagttagggggataaagatgaagaggtatgagactattgtggtgcaagagacggagggtgttatcagtaaggggtatattaaggtgagaaatttggtggatggatctactactcaacatcatcaaaaaacagttgatgatgtaattcgagatgtaaataaaaaagggtttatgttgtgtggaatagctaagggggattgtggaagagactccttttatttaagtagggaatgtgatacttacaaataggttgttaatgggtaaagtggatagttgggagcaccaaatattaatttgagggtgatataataaggctataaagtaaaaagaaaggtgacgggtatggatagagtttttactgaacatgaaaaattgatcaccatacatagagagtataagcatagtttggaatacgctgctacagtgtacaataacagtcagtcaatgcagttttcaaaagacacaccgagaaaagctatagaggcggaaggatacattttatcgttaaaggtaaagcatgaggttctgcttcaggtgcttgctgatgggaatatggatgaggaagagtatagggataggctccggggaagtaagattattttaaagaaggtaagatccttgttagctaaggttaaagaagattatgatgattttgatgaggcgatggattcttttaggtctttaactaatgatttagaagaggcggggataattaaaaagaagaaaaagaaagaaagcgaaagttaggggcggttaaccgcccttttttcatttccaccatccgaacggatggggtcagtaccgggttcgattcctggtcacaatttcaagtgagtttgggagcctagtccgggttcgattcccggagtttggaaaataattttttaatgtggtttgaggcgatagtattcttactctataatgtacgaaaggagggggatgctcttgcctgaaacgataaattgtgtcgctttagatgatgtaataaatccgtatacggaagaggttcttatatctaggggagatgaatttattgcgttctacgtgaaaggggattcaaaggtatttgtagagaaggcgggaaaaacaatcgccattggattaaggtttataaagatattggggttgtaatatttattgttggaagtacataaagggtagaggttaataaggtattccatatttgaagaagcgggtttatcccgcttcttctgttttatttgggttcttttatatagtccagtaaatttgggggttcatcttcaagcagagtatctaacttctctaatatctttattttcatatcttgcgaaagatcttcttgttcatttaagaccgtctcttttacatgtcttctgatgttagattcaaggcgacttagtatataatcgatttctttcattctggtattcatttattttcaacaccctttaggtaatcccgtaattgcttcaaggtttttttgtgccaataagatatgttttgttcggattcttcaaatattcgacctatctctttgtgggtgtagccatattcgtaataaaaggttaaaattttacgctgcttctcagtcaatacattgattgcttccagtaaatcctcattgtctgcagggaaatttgtatttgttatgcggttaaaattgattgaaggttgtgatgtatcttggagaagtagagctagttcagtgtcggaagattcagatgccggcttattgagtattaattggtaacggtcttgtcttcgtcttacccttttgttgtagtccgtcgggtaacgttttataaacccggataaatagcggatggctctgttaatgcgataaaaggatttaaactgtttgtttagctggttaaggttatcatcagatggatcatttaatgcagtgtaaaaagtgtttttgtgcagagggtctttcaaaaactccaaaataactgggtttttaagaatcgattgtaggttgttttttaggtaaaggatatcttttaactgttgacagtctttttgttttcgacagtgagaaactgagtctttcatataaaaacctccttacctatatagtgaaagaagtctgcccaaactaaaaaataggaacatctgttcttattatacaatacttggatatataactgaaatgatattcatactataagtatttgttttttggggaagatgtgtcactggatagtataagagatcagttagacgaaatatctcggtttttatcaatatatgttaagaggattgtatttagacaggaacaaaaacggttaggggtgttgaaatggatacatcatttgagggggttatagctgcggtagggaattttggtttcccattagttctagctgtgtatcttttaatacggtttgaaaagagaatagagaatttgactgaggcaataaatcatttaaaagaggtcattaaaaagtagggtcatttaaagaggcggttgtctctttttttttattttgctgtcgataaaaagaactttggataattaagggtgtttgttaaaataaaggaagggtaaccaaatcatttcggggtggtggttgtttgtccaaattaatattgtctatagttctagttataaatttgttttatattttgaactacttatttgagattgtggatccgttcaatattttaagcggtgtttggttagctgttttcgtatttggggttatagtttctttagtgggtttgttcaggtataggagattatctggagttgggatctcccttgcattaggtgtcttagtcacggctataagttctttaggggtatatggattttattttttaatggcaacttaaacaaagaagaggggttaaccctcttcttttttattaacaaacgcttcctaagcggtttttagcgcattcgtaaccaaagtccgcaaccatgtaccaaccagggtctgatgttttgctagcgcatcggtaaagctccatatcgcacccgttatctccatgtccgaaattatcccagcaacggtcatgagcccggcagcaacggtctaaagcgttgataggggttccactaccacattttgcaccacaccatttatatctataaaacttaccagttcccgggtcaccaaagattaagcaaccatggtaccatgcttgtgtttttacttcattcccatcaatttcttgggctgggttcggaactttcaattgttctataaatttgtagtaatctgggttatatgcaaattctgattcgatttcggggtttccatctgctgacaccgtgctgcggactatgactttctcgccggattctttagtcactgtctggtgggttaatactcgaatattcccacatttttgtctaactgcttcaataatagcttcggaacccaaggttaaaaatagagcttcttttttaagctgatcttcttgttctgggaaaaagtaggtaaattcaaacgaatcctgttctggtgtttcgaacagttggtggttttttgctaattcttgtttcaaggtagtgaactcgctaaggttagatacctctttaattaaagcttctgtacgttgtttattgagtggtgtaatcgtgattcccatttgatcaatctcccttaattttttatggaggcggcgaccggattcgaaccggtgatcagggatttgcagtccgttgccttaccgcttggctacaccgccaaaaggcggggcgttaaccccggaaattagtagcagtcacaccggttaaaaaccatatctccttttggggtgattttatactctgctgggcatgtgctcccatagctgcagcatctgcggtcaggtcggcaaatgagttctgattgagccttaatgggtttatcattcaattttttgtccatatttgtatccctcctttatgctcctaatattaaaagtgacattggattcaaaaaactaaaaagaaaatgaaaatctttttaagttttataaagaactcatcactatttaaggtataaggaggagatgaggtatgtttgatgaatttattgtgtatataaatccggattgcaacccatgtaagatgttaaagagttggttagataaacaaggtattacatatgttgaaaaagatattattaatgacaagcaggcggctagagagttcatgagtatgggacttaatttcaccccatattcgcagataatagttaagggtattaaatatgatgtagttggggcggacgtaatgaagattacagatatattaaggttttcggatggtggaacagatgagtattgatgactgcattaagagggttcacagtataaaaaccgatttattaaaggcagctcaaagtattgaccagtgtaaatgtaatgaagatagggaaatgtatcaaaatgttactctttgctatgctaaagcacttaaagatttgaatgaggtaatggaggataagtacgggattcaggtatgtaaacaatgtagtaaataaaaacgttatagattaattgtaaaaaatatggtaaagtacagataaaccttctttaaagctgctgagagtgtggttgctggtcaacgcactctctaataatgaaatagtgcaaggactgtccttttggcagtccttttttctttgattgtgggggtcaatacaaaggaggcgattttggttagaatgtttacagaagcaaagcatttaatggatcgttaaaggagattatttatgaaattaaaaaagtccgatttatctaggtatattgagagtggaaaagaagggtatgtagctgatttaacatctatacgttctaggaatacttcctatttggggaatactttgagaagttattttcgtgaacagattcctaaatatacgggaattttttttggacgaagagggtgaggaggttttatcagagttaaatagacttattaaagatcgtaatattgataaagcaaaattggagttcccagtgtcctcggggtctaacctatatttagtacctgttggggaaaatttagatttggttgtaaatgtgtgtgatgagtattatggggacggggactatgcgaagtacgttggggttgaatcgatcatttttaatgacaacacaacggttaaagatttaggagaattaataaagatagttaaagatttgttatctaatataggttaacctgtgagatactttagttattaaaaaattagaggagtgtttgatttggatccgaaggaatttgaacaaagaatacttggtgaggaaattaacttggaggcagcagaaaaggatcgggatccagaagcgatattgatgttgttggaaagtatgccttacaaggaatcattaccccgtattgcaagtattattgaatcggatacagtgaataagaagggattgccgttttatttaaaagcgggagagtatagcggcaccacaatggatatagggtatgttgatttaacgatggaaaagtggcatcaaattgaatcagtattgtatttgttcaaccctaaattttatagattggaagaaaacagagtgacggaaataaaaaaagaagatatggtgggaaccattaaatttaaagaggggacagatgtggatgcaattatttaagatctggtcaaaaaagaaccggagggataatggatcttcccgagatcgtggcgttgaggatattgtagatgaaaaagaagaagacggtgggatgcagattcatgtaggtgcgggtggtttattggattctactcgtactgataaggaaacgtattatagggacatcaaaaatagtatgactcaggatacaataaaccgcattagggatattgcagttaagtctaaaaacaaaaatgatcttttcagcaaaatggaggatgcagggattcctctaaaatatttaattgcgctagatccggcaagctatgaggtggatgtacagtcatatcgtacacttaaagaaaaagggattgatgtcacaaaggtattaagcaataaagagatattggattttgacgagtcctatgctcgcgagattataagtatgaaggatccggttccagaattaaaaagagcggttagtgtcgacgataatagtgtagatgatattgaaaatattaattatgaagatatacaagaggatgtagaaagagaagaggaaattacaaatttacaaaagggcggaacagagttagatcatgtggatcataaagataatcaagaaatgtctgaggtggaagattcgttaagtgggggtatcgaaggggttagtgacgatactgaggcggttaatgtcggagatttagatgatagtgttgatcagaaaggtgagggtgaagagaacggggaaccactctggaaaaactatcttgaatccttaaaaaatgatattggaaatagtaatggggaagatgacaacgacatagaagttattgaggacgcagggattaaaaacagacaagtatttatcctatccaataaaattacagaggtggatgatatggatgggtatgagtttacgattattgaaaacattcaacaggttaatttgtataccacacataaggataatttgttggtgataactcaaaacattccagaaacccttcaaagaccattttttagttggctcacaggggttatagatgaaggtgagaggtatcggattgtaaccttaaacagttctccagtatctcataaattaattgaggatcggattgatttaacgaaagaaagtttggatgaatactatgaccgtagaaattccgatgattatataggggacggggctggagaattttttgatatttccaaggtgttaaatgggggtacatacgatgagtaatggtgtgaaaaacagtcgggcgtctattgtagatgattcagaaaaggttttgccgaatggttttagaagattgaagccacaagagaaagctgaccggaatcgtaaagtattgaatcttttcaatgaagctgtatcagatcaggttggggcacaagatatctttattgtagagggggaggttccagagtttcgagttaagggtgtgttgatgaaagtaaatcagttttatccttgggatcttgatgattttaattactttcttcgaaatgtttcgcagcagtatacaaaatcgagggatcgtcttgatgatacggttttagatactaagttttattcagcgttaatgagggataatgagaaaaaatacgattacagttttatgtttgggaaaaagacttttcggtgtcatgtattctccgcatcagcagctaatgatcgtagagaaaaagcggctattgtaattcgtgttattcctcacaacataccaaaaattctagatttaaatttacctaaagttgttgaaaaaatccctaagttccaaagtggattggttctagttagtggaagaacgaatgatggaaaaagcactactgtagcgtcaattgttaatgcaattaatttagatatggaacgacgtaaggttattgttacagtagaagatccaattgagtttcattacaagcaagcaaacgctaagattttgcagagacgggtaggagataatgttccgtcatttgctagggcgacggaggatatacttcgggaaggggtagatgttgcggttattggtgagcttcgtggtgaggaggagatgtataacgccttaaagttggcagagatgggcaaattggttatctcaacaattcatgcggattcagtagctgccactgttgaccggttcgtgggagagtttagtgcagatatccaatcaaatattcggtcaagattagttgaaaacttattggcaattgttcatcaaaacttagatatttataagggagaacaatatccaattgcatctgctttactaatttcagataaggaaatccgagataaacttcgggcggcacctacaagggatggaattaataaactattggaggaaggagatccaacatgggctgtaacccgggaggatgcgtataaagagcttctcgatcggggggttatcgatgatggtgcaagggatttatttctatccaaaacccgggtataacttgattttgaagataaattttggtaaatttatattatagtaacttccaaactctatataaattcgccaaagagtaggttccccgacctactcttttttctttttcaggtaaaaggaagaagtagtgtaaaccgaaagggggatataacaaccaattaacaaaaaaggaaagaacgataagactagatgtgcgacaatttttaataaacttaattactttctatagaggatgggagatactatgaagtttcaacacgcgaatgccggggatcaattgatggagtctttacagcagggaacaactttcggggatattcaggttttttctatattgtttttggttgtagcagttattttagcaatgacagtgttcatggcgccgaggtatagaactcaatttctttctgttgcttctacaggtatgatgttattactgggagctgtattcattttgtgattttgtactgtaacagttgaagattgatatacttccggtctttggccggcttttttggactctatactttacaaaataatatatttattgtataatttaattaataaaacacagaggtgaacaacatgttaccaacatccttcaaggctaaaattcaaaggttattaattaagaatggttttaaaaaatcatcaaaaacaaaagggagaatccggggtttagacaattacacggatgggtttgattttgagaaatcgtgggatgattactatctgttttacacctgtgggaatacgatctatagaggtatgtcacaaagagatcaagatcggaaaacagaaaaaatgtacgaatttcttgtggatcaaggattagaggatcatgtaaaactaacagggttgcgatcaaagaaggcaatcttattaaaaccataataagttaagtaactgtggggaaaggtgataatgtaatggataaacaagaagagttaatgttgttaggcgcactactttatgatgttaggttaaactgggcggatgagatagttagccgcttaaaggaagcgaaaaaattggcagcaaacaataaacttaaagatattgaagagaaaattgatgaggttctagagaaggaatatgagtatcagaaaaatccgtacaaaacaagttattttgacggcagggttttccgaggatattacgaagatctgctgggggatcaacagttagcgggtaaatcgattgagtttcaggcggtagtaagggatctttgtacttgtggagacggaatttttgaggattgggattaaaacctaataataacaagaattaaaacaatacaggagggaataaacatggacgaaagacgttgcttagaattaggatacatagagataggtacgatagggggagttaagtacatgggaaaggttacggatgaaggggatttattgtatgtacaggttgttgggggtcattcagttgggcatccggtaaccttgggaatggctgaaattgatatgttcaagcagttcatggaatcaagaggataaatatttaagggacaataaaacggttaacggaggaattgaagtgagtgtggatatggattttttaaaagaactcttaaaaaaagcaaaattagaaaatgaagattttattcaaataaacgtaaaggggtttgaaaagattctaggtgagttggaaaataaataggtataagaaaataaggtggtattatcattatccagatccatgttaacggttggcttttacataacgagagtggggggtacttatgaaagaacttaatttaaaccaatatgtttatgcgaagttaaatgaaaaagggaaacaaattattgaaaataaacacgatttggatagatttataggggacgatgaaggggtttataagtttcagatgtgggagttcatgaaaattttcggggtacatttaaaaatggggggatctgtcaccgaagataattgtatttattttagtgaggatggtcttaaatagagaatgattgtaaaagggatttaatgcactaggataacagtgtaagatattactgaggtagagtagacagttactgtctactttttatatttgaggatgtttaagaggaaaccaattggagggttaactgttggaagttgaaataatggatgtactcaaagaaagaggtatagaggtaacacgagatgttttgttgtttatttacggtgtaaagccagcgtgtgtgctttccagtaataaaagagggttggttcatgtatttcaatccgtttatccgaatataggggtacagagggtaccgaagaagtttattgatggtggtctaaaggttgtatcacgagagggtagagagtattttgattataatcatggagaattggggaaggttctgggttatccaccggaagcctgtgattggttttctaatttactgaggcggggggagttaaaaggtacagataaatgtgtaattgattatcatggtatgttatttgcttgtgcagtggatatggtggatgattgtttatcttgggtaaagaaaaacagaccggtaccggatgaaattaaaaccgaaatagttgtaaaaaagtatgttgatggggaatcgtgtattttacttcaggaatccggtaccgaataacgggtgtattgggtacgtgcggataaagaactcaaaaaatttaaaaaaggaatgtgataaagtagacaatgtaagttaattgtctactttctttatatcccgttgggttatgcggagtaccaatagcgagtaatgggatattttaatagtataagcaaaaaattaaacaaaatacggaggatcggttaagtgaagaagtttttagcaccaggtttgattgttgtggtactgggagctttcgggctgggtagtgcagcgcatgctgtgaaaacaaaagaagatgggtttaaggagttaaatcactgggagaccaataatgttgacgtcagtgtaattgttgatgagaaaaccaatatagagtacatagtaacggggagttcatcaaaaaacggtggaaatataactccacggttagataaggatggaaagccaattttatataaacaaaatggttcgaataactagaatacaaatctgaatatacaggtaggaggtagctttgtatgatgtggatattgggagttggcataggattcttagtggcagcggtaattgcacttgtggtggcgaaaaaggtgtttaaggtagataaattatctgtaaagtatttagtgggagttatggctgtaatgtcggtttgttgcgttctaatgtccagttttttcttcactagtgaggctagggagtataaggcgctggggttcctatggatgcttatgggggttctaatgattttggatacgcttcgtaggcttctggcgaaggtaaaagagaataagggatatggaaaaaacctatgatttaaaattggttgtttgatagttgtcgccaacacttggcgacttttttgttgcataatataatatataaaaaagaaatgaatataatgatgaatatagatattgattataaattacataaaatatgagcgagggtgttttaaatggttaatactgagagtgctagaaggctaccgacaaataaagataacgagtatgcgacaattcttggggttagctcaaaaaaattaagccatcaggtggttataaacgtatttaagtattcccgagagggtcaattaactgatgtgattgaatcagttgaagcaactgtaccgaagtacctggggagatccggggttcggtggtttttagagaaaaggcttgaagagtttgaaaataaaaataaactgggaatacgtttcgtggtgtgattactgtggagaaccgtcaggaacttattcaaaagttagataagtttaaattagcttcgggaagaagtctaaattgggatagtatgtcggatgaacaattaaagaaatttgcggatggtttggatagtgtttttatagacgttttttcaaatgatgatgaagatgatattgatggtattgatgatatataatgcattaagaaaaagactgttgaagtacatctcaacagtctttatttttattcgttatcatcttttttcattaaaccttcggagataaagaattctttcaaaatttcatttaccagcttggatcgtttaccattacgaccttggttcaaaccagttaagctgtctaaaacctgtttaacttttgggtcaaagtaaacggctgtgggtttaattgtttctgtttttccttcggataggatgttatctaagagtttacttcctgttttaacattattattgatattactattgttattatttttatcttcaatattattcttgttttcgatagtgtgattaatcttaggtgagtttgctggtcttccagcatcatatgatgtatccgcaaatgatgttaaacttctattttttcgtgccaactccaaaagcctcctcaaataaactgtaataggaatcgatcaatctattgctgcttttctctaccaatactgccggcagcttttcgtatgcaaccgagttagcagatcttatactcttagggattacagtgtcaaacatgtgtatacctttttcgtagcagtatcttctgcactcttgtaaaacttcggtgtgtacattagttcggctgtccaccaatgttccaacaactccagctatttgtaaccccgggttatgtccctctttaaagttctcaatctgttttaaaattttggttagtgacctcatagagtatacttctggttggaacgggataatgatttcatctgctacgtttaaaacgttacctaaaaccaaaccaaggttgggagggcagtcaattaaaatataatcgtatgactccttaaccttttcaacaatagtctttagtagtgctgtaggtgcgggatagaggtctttttgggtaatgacatctaattcaaaaaaccccatgtcgtcattactcggtaggatgtctattcctttataaacgtttataatcgcttcttgcggctcattatcacccaataaaacgtcatatagagtaatctcaaaactgtctgggttctgcccgaaggttattgatgagtttccctggttatctgtatcgataattaaaaccttcttattagattttgcaagtaacccagcaaatgatgtagtgattgttgttttgagtactcccccttatttgtggataccccgataactttagccatagtatacttcctccctaacattcattgatggcaatataggttaccatcttttgatattgttctatgtatcttttgaatatcctgtccagtttaaggatgatatttttaaggtcaggtattcaataggaacaaagaaaatattaacggaagaataaataaatatcaatagtgatgttacgatcaatgttaaattgaatatcgttgatacaattattttaagtatcaatatttaaaattaataacaatattgatattaataataaaaacattctttaggatcaataaataagaataaactggataagaagcttacaaaactgaatataaagattggttaagatagaagatgtaaacagataggaacaaatatatctaggtgaagaacaaaacatcattgacaattttatatataaactgtatagtaaaaatatcgaataaaacaaataaataaagccaaataaaaaaatactttgacattttgatataagtattgtataattaaattacaaacaacggatgaacaaataaggaggaaatacaaaatggctaaacaaaaaagattaaactatgaattggttggagtgctttatactaacgggtatacaacaaaggatattgctgaaatgttcaactcagttaatggacatatttcaaaagttcttagagcatctggagtggcgacacgtaagcggggagaagttgttgaaaagttgccttttgattgtttctctcctgaagataaaaaagtagtattaaacagcgaaatgaaggatatgttaagtagctatttaaatatcaaggaagaaaaagaaatagttccggaagtaccttttattgaattatccctagaagataaagcaaaacagattcaagcgttgcaggatcgtgggttatctcaacgtggaattgcaagagaattgggtattgctcaatctagtgtgtctaaaacaatgaaaaagtatcggtcatcagttgcacaataagcgcctactcttgggcgcttatttaatttaagtgggatgattgtgcccgctctgttttttgttgttcaattaagtacactgtaggtagagatttttgaaaggaagatttaaatggctcacctaaagtataaggatcttgttaagtttttaattgaggatgaggatcagaagatatatctaaaggagcttgccgattaccgaaaaggagatattcgaacatatattaaacgggggattttttgtgtacccgcacttgatgagttggattatattttaaagaagctggatttaacaatagaggatttgggtttaagtgaagaaacagcttctatgttagaccgaggttttattatccctgtctggggatccagattgaagccgctatttctaattaactatagttggcttagggataaatcgaaaaagtatataaatgtgtatccggctgaaaatagagagtatatcaagaagatgaaactttacggggcacacaatttaaagcagggtttaattgaagaccggatgtttgttgtagagggggcttttgacgtattaaggttggagcaatacggaataccggcatcatgtatattgggaacaaaaacaatgccttatcacaaacatttttatgctagatttactcgggttatttttgtaagcgacgaggatggttctggggatgcagcgtatcgacaatttaaaaaagacattccccatgccgagaggttacgtattactgggagggctaatgacgttgatgagtttgggggcagtaatacacgggagtttcaggagtggattgagtacgcgaaaacacttggggtaaagaataggaacttaaattgacaattttatttataaatagtataataaatttaataataaagtaaggaggaattactttgaagagtgaaattttaatgaaagtggtcaattccggtaagctcccggtagttagggtaactgatggaattgtggagcatttccaagaaggtttagacccgggaatgttggtaaaggttaaaggggtaactactactgatgatggtgaaatagaaattttattagacttagagccttttattgatcacaataaatcagttgcaaatccgaatttttataacagcaagggggaggctgtcctcacttggtttgaaacaaatttttatccagatagcgggatttatttgattggttttttggaagatgccgacttaccatttgagttcactgaaaataactcgctactaaatgagtatgtggcggagggttcggataaagggtatgttgagtggttagaggatagagttcagatgttagagggaaataaataaaggagaataggaatgggaaactggagaatagttaatgtacgggggttaattgaagacaaacatgaggttgatgctgcgattcgttatcttactgtaaatgaagatacatacaaatcagaggcattaactgacaatgtgttttttcttcaatttagtggacttaattcaatagcggggctaaatcagtggattcaaaatacaggggttatatggtcaaatggggttgtttttgaacgtgattgcactttgagtgacttacataatgaattagtggtgttagctaaaaagtttctgagtctgtcaatggtactgaatgctgggggagaagacggatcattggattgtgtaaaaacgttctttgtaaagaagggaacggttataagtatggatcccattatttcaaaaattaagcccaaggaaaaatatccatcgttttctgatttactagagactataagttaagcagttagtctgaaatggtttggggtgttagtataaaaatttgggataatacaaaatacagtctcaggattatttaaagatagaacaataggaggtccgtatgaggaaagcagtgtcagcgttattgagtgtttcggtattgtcgttaagtatggtttcaggtgtaggaaaggcgcatgcagctgaaggtgacgtaattaatgaaaaatggggaaagccggtatttgtatatggtgaagctttaactactcaacaaaaattaaagacattagatctattaaaatcccaagaggataatgtaaagtcggttagtgtcaacggtaaagatttagtgaagtacttgggtgaaggggatccaagttctaaaatgtattcttctgcacttattgaaagaactgacaaaggatcgggagttaaggtgagtattgttaccgaggagaacatcacagaggtaacagaaaaccaatatgcaaatgcaatgattacggcgggagtaagtgatgcggatgtaaaggtagcatccccaataaaagttacaggagaatccgctttaactggtatctataaagcttatgaggcggaaggtgaaacattagataaagatcgtatggaagcggctcaaaatgagttggatgtcacaacacgaatagctggtgagaataaagataataaggacttcaacactgagcagctaaaccaggcattgattgatataaaaagtgaattggcgaagttaaaagaagatcaagacaagctggcgacaccagagcaaattgaaaaaatcgtgaatgatgctttaaaagacaatgatctggacggggttattacaaatgatcaggtaagtcagttagttgatatggctaacaaatatcaaaacacaaaagctattgactctgctgaggtaaaaaaacagttgaacgatttagctgatcaagttaaggataagttgtcaaaactgaaagataaagctgaggagactgggttctttcaaaaaattggtgatgcaattatgagtttgttttcggctatagctgggttattcagttaaagaaggtgttggtgatgggttgcgaattttgcagccttttcatttgttttcggttagattttttataagagaataggagttggataagagtgggtttagatgtggggtttcttatagatgattcagataagagaatagaagatttaaagagtaatatgatggaggttaggggttctgtagaacgtttggatcagtgtaccaaaagattttacttttcaacaaaaattatgtcagattttttggcagtaattgatgtgtttgatcgcaataataagcaattaaggattcgtgtgtatgtaaagaatacaaacatacaaggaagcggagaattgaaatgggttaaggtaagtaaggactccaacatgtgggcggtttcggtacatagtaacagttgggaaaaagcaaaaaaagaaattatgaattttgtaaaagaagagttatttcaagcaagggcggtatagagagtagacatgattaaggataaagatattatggggtatttaagatatttaggtgtcggttcttttttggatactaaaaaatttcaaaaccattttaaattatctgaatatagcgctgtaagtattgttgatcaattaatcaaaaaagggtatttgtccgaatatgcgtatgcttggggtgtacgtaagattatgaaaacagaatattgtgagtaaaatccgcttcggcgggttttttatttggttaaaaagagggtgggaaaaaagaatgaagatggaaaggtgtaaataattagggaggagttgatatatttgcctgccatagatagagaggaagagcggttaaattcaatattgtgtgaagtaaagtcagaaatgaataagtttctattaaaaaattacggaataaggttagatattccggtaaaagttagctctagattagttgtaagggtggcaaagtttgagtatatgtatgtttccaatgggagagataaaagatctataccaggaacagaacaaattaaaattcaaaaattatttttacttcgagaaagtaaacagaaaatcctgcgggtagcttttcatgaagctgtacactatgcctgttatgttaaggggattccgcatagggacggtaatgttgaatttgaaaaagagctgcagaggcatggactacctagtgagtcagtaacaattaattttgaggatgaattacttaaaaacagatatcaatatttatatgtatgccaacaatgtaatggagtagtaaaacgaaactttggtaaaccaaaaaagatgctggcggggtctgttaaaacgacatgttgtaaggcaccggtcaaatacttggggaaagttccttggttagaggcagagaggttatgtgagagaacactaaaaagaagaaagggtgggaattaaaatgtatgtaagtaaacaacgaaagccagatgatcaggatatgtatgatattgtagatgaattaatggaggggctagggaaaacggctaaggacaatgagatttttgctgtacgggaggttactgctgggggttagtgagggaaaaaattgatcgagttgagggtgtatctcggggggacttaggtgttgagagtcatttaagaccgatgtataacaaggattcttatgtaatgaaatcatataatgggtcagttggtgtggttgctgatgttgtttcaaattttagggggtcgctgagtgtgcagatagccataaatgttaattgggaacaatctgacggtgatgatgattttaacgaagcgttttcagaatttcttgaggagattgaccaaaagttggagacagaaaagattaaggaatatgggaaggggtttgttcttttatctggtaaggatgaagtttccaaagtaatagcattacataaagttcattcagttgatcaacagagcaaaggtatacatccagttgatagttttttcgaaggatttatttcaagtataaagtcaaaagaggatttaatccgggttcagagaataaacgaaaggttaatggtgtttttggagtcaaataagagtttaccgaggaaggtagaaaaacttaaagggggattgttggggttaagaatcacgcagaaaagtcatgtaatattggtgacagctacaaaggcagctatttatgattccagatctaataagttgattgaaatttacgatacgctgcggaaacattctctggtcgaggcagagaagaatgttaaaaagttaaaaataaatcttttgattccatttatacggataatggatttcagaagaaatattcaggaaagggatgcttaaaaattgccggttacaagatttcagtttgagatgagtggtttatatgaaatgctgcggtcaaagctgaatgagtattatcaaattggtgatgtggttattgaggatctgaagtttcaattgaggctactgggggttaaaaaatggagaagtgttgtagtcgacattgtgcccggggaggttaaggtttacaaagaagatcggagcgatccccgcgattatatggtacatcgttggggagataattacgatatgtgtgcaggtcgtgtaaactgtgatgattatgatgagcatcttttttggcagcatatagggggacgaatggtactggcagtctctcaaattgaaggacgggagttaaattatataacagaggatattgttgagagagatacccgtgtatcaaaaactgagtatatgtcagtaatgaagggattagaaaggctaagagactcagtgaataagtttctgggtatgaacatgagtatttctccatcagggtattttacggctaaacactataatacgggtatagcggcggaggtacatactgatgactttacagtgttggtaatgattggggtcggagatatatctgttttgaatctgaataatagaggaacaggtaatcgagttgaggatagggtgttgagtatgattcgagaaattgtgaggaaccggtcgtattctagggtatttgatcatgaaattagggggtatgtttatgtataagagcgggcaaccgctctttttttgtaggataatcctttttggctgaaaccaaaaaatatataaagattatatgtctaggaaaggagtcagccatgaccaaaaatattgtgaggggtcttttagtcttgtctgcagtatctgtattgcttagtgcatgtgaatcagatgaggaaaaggcaattagagaggctaaaggaaaatttaaggtattgtacacatatgatgaggatcaaactagaccaatagttgagaagaaaaagactgtggaagagttggcgcaggacattatgttaaaagatgttggtttggatactggaatagttacgtttaagaaaaagggagtagcaaaaaaccaaggtgtgtttattgagtctgccattagggatggcgacaaaattccgaaagtgtctgcaatgtcgaaagaggatgcggataaattaaaggtagacaacggtgatgaatttgctgaagagaagaaaaaagagtttgcaaatcttcaaaagcaaaggaagaaagtattaaaggatcagtataaagatgatagtaaagaggaaaaggaactggagcaagagttaaagaaagcggttgaagatcaaaatgaaaaagtggagaaaaatagtgactagagggtggaagatcggatgaacgagacaagttttaagggtgtgttaagtagtgatataaaaaatctgttggatcgtacatttccacatttgttagtcgaaaataatacacaaatcaattgggaagagggtggtcagtatgaattgagtttgtatcatgggcagctacttccgtttattgtaacaagtgcattcgccttaattgatgtagtcagaattgaagatggtcagaagaaaaaattaggacgtgttaaatacggtgtgattttagaagacaatgacccaatacatagaagattgttagggttgcctaaagacttagcggaggaatcgggggagttacaccggttatgggagatgcaaattagggatcgaatagatcgatttggttacggggagttggtttccggatgtatttttgtatcccagggatctaaaccaatacctactaaagatgaagtactgaaaaggtttgaggatcggttagtagaagaagtggatggtttttttgtggctttaatggggaaggagacgtttcatccgggacagtatttggttcaatattcaactattgaagcggggtttgaaaagagttggaaggtgttagtggcggttgatgttatcagccgaagaatgaagagcaaaaagaaaattgagataatgatagatacagggttgggggaaaatgttatagagcctagtttagaagagtatagaactgtagctaagaaagtactaattaattttgaaaagagtacaaggtcagtaaagctgggtaaggttgaattttcgtttaaaggacggccatctgctccacattaccttgaaaagataaggggagacaaagaggatactgaaaaactgtttggaagaattaaaaagatatttgaaatggatgaaaataaaaaacatatacggggcagggaattgatagcacctggggtgttgaaagtcacgttaaccccaaatattcctttatttcttggtgcttatggaattgctgcgggggatggtgaggttttgtatcggaagggtgaacagagtctacaagaggggttagtaggcttaggtaaatacgctggaacgaaaaaaatcttattggatatcatgaggtgttatgactatcgtaagggtgtgaattgatttgaggttaaggggatttcattggggatttttaagagcattatcgaatacggtaaaatccagtgctatatttgctcaattgtacgctagaaaagaaactgtggctaaggggaggctaataacggcgggggtgatattgggaacaactttgattaatgctttctcgtatgtagcgcagtcagtaactagggggtcgtcacgacgaggtgggaacagtaggaaaaccagaggaaagtcaaaaaacggaggttatttcgatcaagacggttggggaaagggaagaagaattgaacgagatttaaatgattttgaagagcaagaaccagtaaaagcagacaaggttaaggataaaataatcggcggtacacaaacgggagataaaaaacctattcatgggaggtggaagacatggttagggtctggtgaggaagctgttttagaggaagatgagtttttaaaagttcaggaacgtgtactgggtgtgtgtcagaagtttaatttgcggtacgagtgggttggggaaatgaagatgatgtgggtatttgtcgatggaaaagccataaaaataaatcagagcgggatatataacatggtggatggtgtatactacattccggataacatgtctaaatcggcggggctgacaaggtttttagttgatttttcacatgagagaacgtatgtgttaatgggtctgattatggcgtttcataaaacaatatatccttatcgggaatacaatgatcctgcctataaagtaaacgatgcggtataggggtacaataggtaatattaatgatgaaattaatagggatattaatagggatattaatattataactataagcggatatctccgctttttgttttgataagcaatctataaatcaggaagtaaatagatggtagagtaaagaaaattaactaaggagatgcaaacatgttagaagctaaactaaacaatgataaatcagatgataaacaaacaaattcagaggttaagtcgtctaaagaagttcatgacatttttgatgggctagtaagaggttcatgggtagaggttaatccggttccagagggaggggagacttattactctattggggcttacagagatggggttagagttttgtataaacctactaatacagggttaacgggtacggttaaagaagcattgagacttgatgggttgggttatgactttgttgtgattttcaatatgtatcgtggggatattgttgagaagtatttggtgtaactgtctaggtaaagtaaaggcgaattgaaaaagtacgaaaggtaaaacacggctaaaatattaaatggaggagtttatttggggattgggaatgaattaatcgtgggggatacaggtacaggtaaaacgagaatgttggttgagatgatcaagcaggtaaaagatcaaaaggtaatcgttgttgatgggatcatgagggagatatttgatcaaaatgatttttcgaggaaccaaaacattgtcgattactttagggatgttcctattactggtacatataatcggctatttaaaaatatgttgagagatttcagaaacggttattttaatgatgtggatgcggtttttattgatgacgggtacttacacttatacacaaccggatcaagtaagttaaaggaagaagctgtagagtttattgaaagtattgtacataagggcattaggttagttattgcgacacaaaaaaatcctaaacagggtaagtataaagatttgtttgaggaatttaaagtgagtaaagcgtgtttagcggcttgctaacattaaaggggagttaaacatggattttaatcctaaaatgactgataatgagagtaaattatttaataaaatttaccggatgcagaggaaacatattttcacgaaaaactttggtgatggggagatctccaaagttactagaaaaaatgacttatctggactctaagtttactttgattcgaatattgatggtcaaataaagattgatgggttggagtttttggaggatgttttagaagtaaaggattgacttcgtatagataaggaggattatgatggggggtacaggcaattaaaataaatgatatagaagaagtagtaattgatgaccgagtgttaattatgtccaccagtagtcagcatttaaatggtaaagagggtaggattaaacaaattaatgttgggaagtttggagcggagttgttcattggtttagatgatggggaaagtacttggatcgatgtagatgatgtcattctaattaattaggaagataacttggtagaataaatctggtggtgataacagtgagtgttttgagcgaaatgcaaaatatcatcaaaaaattaaatgtacattctgatagaggtattgggttagcttatgctttaggtatagaccgaggcgttaaaaagctaacagaggtattgggtgtgggagattccgtaaaggtgataaactccatcagggatttagctgacaggcagtttaatattgctcaagatcatgaggaattgggatctcccgattcagttactaaaagagccaaagctgagtatgaagtttacgaggaatttattgatcagttccaatcgtggttaaagacacaggacttcgatacagtggttactcatagtgtttctgagagtatcatgttaacggaatcgggaaaatgtcacttttggggtaactggggagatttagtggctaggatgttatttgaccctttagtaacacctaaaatatacagtgtttctgaatcgagaggaaaggttacgaaagtgattgttgacttaaatggtttaaagcagccgtttacatctgaggagtttagagaatacttttgtatttacgataaggaatacagcatctgaaggaaattattttaggtgaggcgagcttaggctcgtcttttttgatatcagtatctaggacaaaaataacaaaaataggtagactagtagtaaataagttggggagggttgattatgagtaggttagatttaaagaaaataggctatgtcaaaaaattcattgttgtaaacaaagcggggtcttacttaaaagagggagggacaattaaactatttaatacaaaaattgaagcggacaaagaaattgaatccagcttgagtacccctgaatgggtggcgatacccgtgaaatccgaggtggttaaggtggatcaacaggatcggaagtgcccggagagggtctatggatactcaataagtctaggtgatacatatttaactgatgaagatggtggattagttgtgtcttggacactgtctgaggcgttaaggtctatggaggaagcagtaaataaagttatgactaacagaaacaggttgcctttagatcctccgaatatggtgttggttgtggtggataaggttgagctgatgggggatattaattcgtgataaactaatgttgcagctgagagggagatggtgaaatggttcaaaaagttccaagggagttttacattgaacttacaaatgaaaagaagcggttaacggagcaatttccgtctgattcgatggagaaaattaatataaagttgattgaatggtttatacaggaacgggatatcaacccagctttacagggggttagagtttttgtttttgttgactgtttaaaatatggctgcgaacctcaaatataaaatggtgggtggtggaattatggaagatttaattcattttaaaaactcagtaaagggactatctgaggtgggtttaaacagggtactggatgatatcaaaatgagaattggagaggcttatttatctaatcatggggcgtatttaaagcagcagaagaggagagcagatattgtgctgcaggagttagaaactcggtcaaataaatatcgaaataatgggggttagggattgtttgtaagagcgtgggatggagtggggatgtattccccaattttatctttttctgaaacagggaaaatgttggtgtttagaaatagagatgagtttattcaaggtatagatgtaaatgatccagttatgttggactccggatgcaaggataaggcgggaaacattctttttgaagaggatatagtcaagtacccgaatccgtttgatggtggatattatgtaggtgtggttaagaggatttcaactatgtttacgattgagtttgtaggtaagggttgttcacaagcatgggatcgatacgaaaaggtaggaaatacatatcagaataacgatctattggaaattttatagtgattagatttacaaaggttaaagattgtgatattgtcgcttggataacaacacttatccgctcgaaagttagatgtggtaaattaataatgtgccaaggagcacagactctagattaagtaaataaagggcaaaccggaagcgacaagtcgtttaggtagacccgatcatgaggaggaaatcaataatgagtcgtattagttttagtggagcacgtacaggtcgtagaggaaatggtggtggatttgaaggaatccaatcactaaaattcgatattggggagaaaaaacgtttaattttcccaacatttacagaggaagatggttctaccggtttgttaatgtttgcggaaccataccatccgattacagcaggatttgtttccttagtatcgagcaaagggaataaatggtcaccatataaaattagatgtatgcatccattttcacaaacagatccaaatgtggcacgggacgttgcgtcaaaaaaacaaagatgcccgttttgcgagttagcttcaatggagtttaagcatacatatgctgaaatggaggaacgttatggggatgagttctctgaattagataaaaaagaccaaaaagcgttctatgaagaaatggatggtatgcataaagtttctgcttcttattataaaaaagaagatgctgaaggaaattcatataatgttacaacattagatatctttgttttagcgttggagttgaaattaacgaaagagacgggcaagggtggacgtacgaaatgggttcctattttagatgatgagacgggcttacctaagtatgatcctattttggtgccgatgtcacctgcgcgtttaaataaatttaagaatgctgcggatgctgcgtttaacagtgagactttagattatgagaaacacgcacatccgtttatcgagaacgaaggaactgaggatgaggaagaggtattggttggttgggtagacttttctgttatctttccacaatctgaacataaaatgcaatctggaaaagaaatgacggttactgctatgaatccggcattgtctgtagtaagtgacgagcttattaaagaagttcatgcgaaggcaaaagatctaaaagagaaagcgaaaaaagcgtttgaagcaacaaacgtagcacttcgaccatttacaccagaggaagctatcaatatgatggctgatcagggagagtattacgagcaaatgcttgaggagtttggaaatcctgaagaggatgacaagtactgggaagatgtatttgcaaagattctgaatgggtcaaaggcgactagtgcagacgattccgattcagaggaagatgaagacgatgaagaggaatccaagccacgtaaaaagtctaaaaaggaaaataaaaaatcagtcaagaaatcatccaagaagccagctaagaaggcagtcgtagaagatgacgaggatgaggacgaggaagattttgagttagactttgacgatgaagatgaggaagaagaaaaacctaaaaaggtaattaagaaaaaacctaaaacttcttcgaaaagcgataaaccaagaaagaaaaagcttggttcaaaagcaaaaaagaaagtagaagagtcggaagacatggaagaagatgagttgggtgaggaaatttttaatgcttaattagtggtgtgggatatcgaattttcgatatcccatatttttttaattttattctttacaaattcatttatattatgtataataaaattaacaaataaaaaaggaaagagttgaagtaattaaccaaattagaaggtttgataagctaatgcagaatttagtaatttggaagtgttagactttactagaaaataagttgaaaaggggaacaccttataagaatagttacatagtttaggatgtatttagcaggggagtaaattttggtaaagggattaataatttagtcgatatgaatgaggtaggttagtgtattaggaactgacattgaaattgtgataggaaaaagtaagggaaagaaatttaagttacgtaaatatgaggaggatattaatttatgtctaaagttactacaggaattttgagtgcaaagggattaactattgggggaattgcagcggttacagtagcagcaggtgttacgacgggtgtagtattacataacaaacataatggtgataacgataaaaatgtaccggcatcacaaacacaggacgaaaacaatacatcagatgtagtagggtcgaaagacaaaaaatcaaaagattcaaaggatgtacatgaggatttagttgaaagagcgatcgaaaatgaaaaaaagactgaggtagctcaggcggtaggtgatatagcaaattcaggttttgatcagcatgatacattggtagcaaaagcggttactggtgatcaaacgattgcatcaattcttaaagacactgagacaaccaaaattggcgataaacaactggtggccattgtgggtgaagatacaaagtctattttagatacacaaacacctatcgctgatgcgggagacacaaataaaggaaagatcggtgataatatcaatgtaattcctacggataatagagggggaaattcatcttcaccgacacaggttcctaatacaccttctgatggcgttaaggatgatcaaggggaggtaatgtaccggggactgacaacgggacagatccgacgattcctactaacccaacaaaccctagtgatggaggggcagtggatccaacaacacccgggggtggggatgttactccaacaaatccaacaacacctggagatggtggaacaacaccgacaaaccctagtgatggtggtggaacaacaccgacaaatccaacaaaccctgatgggggaggtactaatccaacaaatcctagtgatggtggaggtacagaaccaacacaacctgggggcggtggaacaacaccaacgaatccgggagacgggggtacaactaaaccgacaaatccggatgacggcactacaacaccaacgaatccgacaaatccaacaaatccgggtgatggtggaagtacaaaacctgttgaggacttggctattaaagctgcagtagaaaatgcagaagcaaaacaaaaggctgcagatgagaaatatcttgaactgacaggggcattaaaagatgtaactaacatcactaagtcagccatgtttgagtccgatcatcttacagagttaatgggtgagtacggaaaaacatttgaggaagcgtttaaagcaaaatcgcagttggatgaactccttcaaaagtttaataacggtactatgattgatgaagaaagacttcaatataatgaacagtttaaggttgtacagaattataaaattcaattagaagataagcttgaagcgttcaacaaagcaatggatcagtacaatggaaataataaagcaaacattgataaaattcgatctttggttgataaggttcacagcacgaatactgaatatcaggctgctgtagatgatcttaataaagcatataaagacgctaaaactaaggacgttgacgggaaatatagtgaccgtctaagtaaagtagctaagagtgtggaagacaacaatttttatcgtgatgacttaaatgatcaatcaaactctttggatgctgacgttaaagcgaaagatcgtgaggactactataagcaggagtttacgagatggtcaggaatttctcatgatatggctgcggatttaaataacggggttaaggatgtagatggaagcaatccattagattctatgccaattagtattaatgaggatggaacaactgttaatcaagatccagaaaatccgtataaggatcctgaatggtcagtttcaaaagaccaggtaactgaggctattatggttgctacaaaatatcaagatgaggcgttaaatcttcttgaaaatcttgaagataaagccaatgctgcaattaaagatattgaggggaataaagaagaatatgatgctgtacaaagtgaatatgataagcagtatcaagaatatctcaatttaaaagcgcaggcggatagttattacaactatgcacagcagttagcaagtaaatccgatgttacagaagaggatgctgcagcgtataaagaggcagtacaaaactttaaagatactagagaaaaaatcaatactcaattagaggctgtaaaagaagccaaggataaaacttacgatgcgtatgcaaaagccaataatgaaaataatgaggcattggattcaacttcgaccgttgttcaagatgcatatgataaattggatgatgcagatgcggctatagacaaggtaagtcgtcgtgatggtcaggatgtttataaagctgatcttgacgagaaaaaagaagatattcaaaaaacgcgagaagaattatctgaaaaagaggctccggcagttaaagttgaggataaatacgaagaaacaaacaaagcaattggtgataaatactatcaaaataaagatcaggttgaaaaggctgagacttcggataaagctgacttagatcaaaaagaatccaatttaaaatctgaaattgaggttacaaaacctgccgaaagcacacaacctgaagagggtgcgggttccgggtctgaaacgacaggaacggatgtatccggaagtggatcgacggatagtaaaccagatggtgaaactcaaaaagtaaataatcaagatacaactcaaaaagaaagtagtgatgttacagaaaacagcactacagaacagggtcaaagtgattctactaaaaatgttgtggacaacagtgagtcgcaagagtctgcagcacaaaccgaatcagctacagaatagggtttgctgttaagtgtagggtactaggataggcactttaaagagcaccgcactttttataggtgtcggtgttctttagtgtaaatagggttaagagattacagtcgggaggatttaggatggtaaagacgagtaaaacagggagtgtacaaattgagtttgttgataataatacggtaagaacgattattactcggcaggattcaatgagtataagggataaacagagggtgtttggaaaactggtttattttacaccaatcagtgaaaaagaggatgcacgcagtagagtctctaaagtcttgtactataaattaaacaggaatgaaatgattctcgatgattatcgcttaatggatcgtgtgactgaagatgaggatattcaagcaaggaatataatgatttcaggactggttcaattatttttgcttatttcggaaggaaaggtgtatgatgttgaaatcaacccgcttaactttgtgtatgataaaaacaatagcaggatttcagcattttacaggaaagatagagcgttagcagagattacggacaagtggctaaatgatgttaaaaagctgttaacatatttccttgtattagatagtggggtagttgctgaggattttgaaaatttaacggttgaagagctgttagatgcactacctgaatcaatctccaataaatttagaaaattattggactctaattcaatttcagatatggcgaaaatatgtttatctgattcggagtttagaagacttctcaatttcccgcccatttttgaagaggcgtacaagccaaaagatgtaacaacagcttctaggatggttccagttgattatacggatatgagaaatcaaagagattctgcaacggagaaaaaagcgaaaaaacccaagaatagagatgcagggaatactggatttaaaaataaagcaattataggggcgtctgtgtgcctctctctggttgttggtcttgttgggggaaaagttctttttggtggaggtaatgtagacttgtctcagcctgtgtacgataaaaacatccagagtgggttgatgaatgcttccatacaaaagtatgacgaggcttccagcaattttgatgaatatttaaaggaagataagaagcaagagttagatgaggatttgaagctgtctatgtatttctcttatcttcttaatgacgaatatgacaaggcgcttgatgtagatcccgggggagctgaaggtgtggtgtcctacctcaaagcaaagaagaaaattaacgaggttagcggtatcaaagcagacttgccggcaattaactttgaaaaagctgtactggatcaagactatgagcaaattgttaagttaaaagataaggtaaaggatacggaagataggcagactagtgtggttgaggcgttagtaaaaacggataatcttgatgctgcattaaagtatgtgaaggctaaaaatattacaggtttaaagaaagcaattgaggattggtcgaatgaaacaattgagaagggttcaggaacaaaagaacagaagaagaatctaaaagaagatgcagataaaaaaatcaaaagtgaattagacaattaataatgcctgacggttttctgtcaggtttttgtataagggggataacgtatgggtgaagttaagaaggatgatgagttatttcagcttctagttagtatgcatgagatacttgggaaaattaataaaataattgatggtgtaggggaaaaggttcaaggaaaaaatgacgagctgaatgatttagatcatattctagagttaaaagatttaaccgacgatcaaatgttggcagtcattaaagaaagaaaagaagttcggaaaagaagaagggtatttaaaaatataaagcatatggttaatttgctcggagataaaaatattgatttggagggggtatataagggattaggtgagaagttaattgaattagagaaaacagtatgtgaagataatcgaagctataatatgcgtacagatcgaataactaagaggtttactgaaataacaaacaagtacatacatgataggagaataagtacaggattgcctttggaggatatgccggataagcctgacaaggtaagctgggtggagagtccggagatgcttacaaaaacattggcgggggttacaaatcaaaggaaaacgcctttaaccggtatagactttgagaagaaaataaaaatggtggttaattaggttggtgatgtgtagtggactggggtaatggcaggggtaataatgtttcagatcgagaccgacttgaattagatgatagaggacgaacaaggcaagacaatacaggaaggcagcaaaatcactctggggtacataattactctcggggtcagggagatccggttcaggtaaattaaagttggcactttttatattgatggttggcggtatactttatatattcaacatgtcagggaaattggatttaaaatcatttttacgtacttttaatagcactcccgaggaaaacatggcagctatgacacgggggatagagcatttagatagggcaaataagcgtgatggagatccggaagacccggtgtatgataaaaataatatttattctgacaaagacattttaaaaatggtggataaagagtatatagtttatgtgtatacaagaaatatagaggtggataagaaatttaacagttgggttaaaaataatcaggatgatatcccagtatataaacttgatattaattcggtagagtacaatggtgagataaggaaatatattgatggggataagcctatgttattaatctttaatgaagttactcgggaggagaaggttctggatagcgtggttaaggatccgtcattattgaaaaatgtaaaaccacatattcagaaacttattggtgataaagaaaagagggggtaacctctcttttttatttgcgaagaagggatataaatacgcactggattatatttataagaagataataaaagggttagaggtgttaatgttgccgggtaattttaaggaattggtacaggaaacgggcgctgaattggtgtgggttgcgggatggaatcgtgaggataatggggaaattcaggcaatggtgtggtatttgaggtctggttcgactctcttggaaaagagtacctgtgtggggataaatcagttcgaggaaagagatggggaagttgctcagattgacggggtaaaagtatacattggtgctaaccatagagaaagagtgttaaaggacattaaaaaagctgtaacccggaacaagatttgtggggacagagtgaagcttagtaacaagtataaaagtgggggatccactatagatccaaacgtacaaaatacaaggttaaggagattaaaaattattctagataggttagcagggttaagtaaagtaagttataagtatgacaggggttttcgggagtttcatgttcggtctttagggggagttacatattattttggcgttaattatgtattcagggtttctaatgggcgggagtatcttcttggtgagtttacaccaagagggaaaagtgtacgaacgttaatgaaagaagtacagaaagataaggactcaaatttatgggttagtttgctgcgtgcttatgatttgcggaggaaagagggattgggttgagagaagcttttttagataacagagtagctaaagagctgcaatttttagagaagattttattggaagtggttaaggatgttgaggttgtttctaaattgtatcaattagaggttatgaatggtcgtggaaatggtgtaaacaaaaaattcctaaatgcggtatggggtatgttttcgaggatacagagaatagctgaaaaaaccccatataaccttatttgcagaacaagtaaggatatgcatgattatttatttccctacagggggagagggtttgtaaggttaatggttaaaaaggattttagacgtattgttttgtatacggatagtggaaatcttttatccataaaggagtttaaaggaggggtggtggttgtagaccgagagaagttccaaaaaatacacttagtgggtgttattgaagagcgttggaagaggtatgctaaagcaaaaaaggtaatttagcccttgaatgcagacaaataggatcacttgttcggtttagataataaaaaaagtgaagatagatcagaaagagcgatagaatgagatgacaaaatgatgataaccatgtaaactaacagtagatgaagaactactgttgggtttataagtgaatggtaaggtgtccgtgtggtgacgggcaccttttttctgttttgatacataacttgaatttgggattccctaattgtgataagataattaaaggaattaaaccggagggatatgtatggagacaggaagaatgagactgaaaacgctacttattgaaaatttccagtcgattaaaaaattaaagctctctttcaatgaatttggagttttccatttaaatggtgcaaataatataggaaaaagtgcaattttaaaagcaattaaaatattgtttacaaatgtttcgaatcagcagtacaaagattttatacgggatgggaaaacatttttcagggtgacaatggaggattatgatggaaataaagtgacgctttcccggggatctgttgattactatgagtgggttatagatggggcaaaaggtagagcagacaaaacaggaggaaaagtgccggttatagttgaggattattttaacctctatcacgagaaggaaaaaaccaaagagatattaaatattagacttccaagaagtacaatgccatttgctgaaacaacacctggagacaactattatattctacagaaagcattaggtactgaggaatatttactgggtataaaaaagactgaaaaagaaaaacgggatgttgtaaaggatatatcactcattgaaaaatatgaggaagaggaatcccggcaattaacagatgtaaatgggaagcttgctaggaaaaagagggaacttaaagaggtaagcaggtatgaggaagtattaattgctgagtatgaggtactggggttaattaacgatgttctaagtttaagggatgaaatcgaagagtcgaataaggttctaagggagaggcgtaaggcaatacaggatattgatatgaaaggcatagaggaggaaatacaaacaatcgaagccatagagaatatcgagaatctaggtattgagattacaaagttatctaggcagaaaaaggagattgatagtagactagctggggctgagattgaggatattagaggtgatatagatggattatctctaatggaagattgtttatctgaaatgcagttggttataaaaatgtctaaggaatataacaatacaaaaaagcggttagagggtattgaaaaagaaatggatgagctgcgggaagatatgggtctttgtccgatttgcggatcggatttaagtaaggttcatgtgcatgcataggttgggggtatacgatgaaaatattaatggttggggatcttcacttatataccaatgaaataagaacaacaaaaaagatggttaaaaataatgaggtcatgcttaaaaacctttataagtatctaaaagaaaatgaggatatagatcttgttatttttggtggggatctgcagcatcaaacacctaaaggagatgtgttaagggaagttgccttgtggcggaagtggtttcggaaaattggaaaactgatggcaccaagaagaaagaggataaagaatttcaaaattcatggtgtttctgaaaaagtaaaaaagggatttgataaaggaagaatctatccattgatttctgttcgtggaaatcatgatgatgacaaagtattaaaggtgacagctgaaaataaagatgactacattaaacaatacacgttttttgatgagttggtggacgagggtcttattttaaatccgaaggggttaacgttcactgcgggtgacgataagttttacatagatattcgaaattatggtgaagctgatcggtcagttcccaagggtgccaagaatagaaaagttatagcggttttccacgataatgtactgcagcctgagtcacctctttggatgattaaaagcaagagcaaagaaggtgtctataatgcggaggatgttatggtgaatgtggatattgggatattaaatcatattcatgagcgtgtagatccgttatacattgaagcttcggatggggtaaaggtgttgtggcagattgggtctatgggaaggacttccttaaaagatgaaaatatgcgagacgtggggtattgcgggttaatagatacagataacctagacagtttcggaacggttgagattgatgtaataccggcggaggagtatttttcctttcaaaaagccttcgatgcgaaaaaaaggaagagtgactatgaggactttgaattgaagatgaatacagttaatcgaaaattccaagatcctcgcgaagatattaaggcgttagaggatgtagacgatagagtaaaacaagtttgtgtagagacactaaccgagataatggatcgtaaaaattaaggttgataattgggggagccgagaggcttctttttttgtgtatactgttatgtagaaagtatggtttagatgggagaggaattttaaaacatggatgagacaaaaaagaagttatctaaaattcctgatggttctattgatttcgttatatgtgatccttggaatgttttaacggttggtggtaaaaagaaaacttttgaaacaccgactgatcgggatgaatatattaaaaaggtgcagaaaaggttagagggtgcctataaaacattaaagagtaaaccagccggaggaagtatgatggttggggttaatatgttttctatgacgtcttttggtgatgctatttttgaaaaagaagaggttaaaagagcattagtatggtttaaagagcaggatgaaacaacctcagagcaattaagggggtaccgtgatgctcgtgaatattttttatggattgtaaaagaccgaaattggacttacaatttgttaaatgatgagaagtatttcgatggagaatttaaaacaaaagacggagataaacaaggagctttatctgttgtaaaggatatggtactgagattcaccaatgagggtgatcgagtactggaggtatcgccggctaaaaaaagcgtagtaagggatgccgtagagagtttgggacgtatttatgtgcaggggaaagtaagcaagaaggggtcgattctgaatgttacagtggaataagatttataagggagactcgtttgaattacttaatcaaattgatgatggaagtgttgacttaatgttaacagatcccccatataatatttcggtagaggggggtaaagccgcctatggtcggggtcgtgtaggaatcgattttggagagtgggattataattttgatacaaaggcatggattaatttagctgcaacaaaaatgcatccagagcgggggcaagttatgatatttaactcctttcgcaatatggagctgatgtctagggaattagagaagttggggtacactgttcgtgcgcttccgtattggtacaaaacaaatccgattccgcatgcacctaatagactacccttaaatacgtttgagcaggtgctctgggctacaaggggaaatgactatgtgtttaatgtgagggagctaaagaaggcggaggacggacgatttaccgcttcaagtcacgaagcacaaggtaagaggtttcacaccacacaaaagcccgtcagcctgtggactccaattatgaggatacataccaatagaggagataaagtactggacacgtttagtggtagtggggttacagcagtagtagctgatgaattgagacggaaatttattggctttgagaatgatgatacgtattacggaaaaagtgaagatcgattaaaacgtcaaaaaaggaaagtaagaacgctgtgggcgtaaaataattatttgagaggattgtgaatatggtatgggtaaggctacagagtatcttgaaaggtatgaggagttacaagaagaatttcaagcagagcaacaaaaagctaatcgcttagaagcacaaattgaagttaaaaaagaggagctaacaaagatgagagccagcctggaggaaaagggcgttaagttttcatctgtgaaggagcttaaagaaataaagcagaaaaaagaagagcgattagatgatttgctttccaaaatggaagcgacattgggtctggacgaggaagatgatgaggaagacgattgggaatagtattcaactaaatttagttaagggagaggtttggttttggtaaagttacagaaaagtgaattatctgcggttttaaaaactgcaggaagaataattacaaataagcggattgcctatgcggacgataattttttaagaaccgttttacataagaatagcttgtggttcagtgctgttggtgatcgtaatgatcttttattatgggcagcagaaaataaagaggatgatactggggaagatgtaaacgttgattataaccggctgatttcagttcttggggtactagaggacaatgttgaaatagatgttgatgaatctgggattcaagttaaagatcgatccgccttagttaagttagcaaatttggtaggtaacgctgaggagacaccgatggatgaattggttgagttacgagatgaggcaaaagacaaaggtgtacgtgttaacagggctgagtttcttggggcgttggagtatcttcatggtttacgagataaggacgctgatttagaagttttacaggatatttatttcaccaaaactaaagcatatgttatgggaactcggtttagtgtgagattggattttgaattacctatcgaatttaatttagattacgattcttctgatgtattgattgcactgttagagacctcggactcggaggagtttgtaatttgtattcaagagggcgagggaacaatctcttttgtggtagacgaaagtttctatcaggtatctgggtataccaaatacattaagagtgttgaagcggagtttaacgcctttaaaaaagaagagactgtttcgttgaatagatctgaatttgcaaggtttgtacgtttagcgacggtctttttagactcggatggggatgcagtaattaaagtttccgggggaaggggcgttattacgtctgattctgattttaatgatggttcttctgatggtgagtttaatgctgagggggtttccgatttggaggttgcaatgaacgcgaaggatctattgctgcttttcgggggttcttctagcttgctgggtgaagagttaacaattgaattagatatttcaggagagcttgggtatattaagcataaaaacggagactgcttaatggctgttcggaatttaaatgattagggagggagacctcctttttttgttgataaaaaacaggcaaattaatagcgggtaaaatgttaaactgataaaaaatgttctggaggacgtaacatgaatagggttgaaaaggttttaaataaggttcaggagctgagggaagaggttatgctcttaggtagggatgctgagacaataaaggggagagtagaaaagtacaataatgatataacaaaattacgagacagggaaagcttattgaacaaagctgctgttgtgtttaagaatgttgcggatgaaagaaatgaggaagcaaagaaaacgttggaggatgttttaaattatgctttggctaatatttctcttgaacagcagtatgaggcgagggtagaggaggttccgagtaaacgaagtggtaaagagatgacgttggtcttgactgatattgaaacaggtcatgaaaggtcattaaaaaaccaaaccggtactgcattatctcaaatcataagttttttaatgagtgcgattgttttaaagttttctggatcttcaagagttatgttgttggatgaggtgttttcaggtcttcaagatgaagagacaattcggatgtttggtgagattttggttgcgttggctaaaaacgaggggtatcagtttattttggtggagcataagagcgagttgaaaaatattgaagggattacggagattgctttgcagctgaaggattatgataaggggttagaggtcagggaaacagtttaagtaagtcatgtcagggcggtgaaaatccgctctttttgataggtctaaaatcaaaataagttaattttagaataaataagatagttgggggatataaggaaaatcaatattcggggaagtcagcagtaaggaaaaacagaaataaatataaacaggatagaggcaataataaaatataaaataaattgaaggtatggtgtgttgagcgattacataaaaagacgaacatatgtttttatcgtaaaatattgagtaagatgtgtagtgaagttttaggaggaataggtgtgaacttccctgtgaagaataacaaaagtattaaagacttagtggatttaggtggtaaatcgggggatattagattatttagagccggagcaaaaaagttcacttcggatgaaaaagaattgcttctgttggaacggtattttgttttaatcgtatatacagattatctacgtccagaggtgaaagagtttttcgtcaatcgaaagtcatataagcaaatttatgagatgtttcccgatatgggtgatggttatctaagaaccttaatttacaatgaacgaaataggttgtttggggatttggttgtggatccattgtatgaagtaaaaataaaaaatttagctgttgaagaagtgaaagctttaaccgataggatagatgaattaattaaaaaacaaacaatcattgattcagtcaatcctttagattatttatacatagatctgaaggaatttgcagatattgatagagagttcaacagatatgttaaagatcaagattttatacaatccgcaaaaaagcttcaatcaatttcaaaaccttatatggaaatggttttaaatgcgatagataaaaagttgttgggttattttgtttatttgttaacaacgaaagatgattctctgacagataaagataaaattaaaaaacggcaattaagagaggtatggtggctgccaaatgaaaataattgaagttaagggtcattcaaactatgtcggaagcaaatctttattggctattgagaatagggtgaaaaaacttacagaagaaggggttacaggtatagttgttgatatagacggtttggctatgaatgaggagtttgtaccgaaggtggcggaaattatggattcgtataattgtaggtttgaagggttaggagagaaagaaggtttagtggatgcctatattagtagtgggtattttttaaaacggaaaatgggagtgtccaagtttgttcgctggttcagagatatggttgaagaagcaaatttcccaattatgattatggataaccggctagctggggatgagcttattattatgaatgtggtgcagcctatgagatttgatgacaaatatttatactacagggtaattaagccacatttattggagccagcgtctttggaaaaagcggtaactgagggacagaatatttggtctaatagagatatcaggttggttgatttagctaaggaggatgtgggtatccgatttgctgctaatctaagggagagaactatgttagacattttttcaggtataatagataagagtctaaaaggattccttgaaagcagcaaggaaagaggtgaaataacggaaagtaggtaggataagagaacttccgttattgaaatagagaggggtaccaatgcaatgttaaaagagaactatgttttaaatactgttcgtgaggaattagaaaaaggaactgatccgaaagaaatcggtgaatggttagggattgatgaatcaacacttatgtcaattcagttggtacatgagacaggagaaaaattcggaaactctttaaaggggcatgaaattctaaatctgtatcggtcaggtcttacgtttaacgaggtgtcgtggttaaagggtgtgaccagtgtggcggtgcgtttacaagtaaatgatttaactggttcaaaaaaagaagatataaaggcagagagtaaagaaaataggaaaaacatcaaaaatagaattttaaagcggtatattttagatgactctgaaaagtatggtaaagaggaagctttaaaacggtcaggatattctaaagcattttttaacaacatgtataaggaattaaaaaagatttataaaccggaacaagaagttgtttcctcggccaatgattgagtctaggcgttagggggttatccggtgttaagagattggtttgacaatgtaaggtattttgttgaggatcataaaaggtggtttgggtggggtattgctgcagttcttataggtttattaattttggttctagtacttcccgataagagtgggagtgcgggggtcggatccaatacaaataatgaattaaaagagttaaaagcaggatcaaaggagcttgaggaagtattcagtcaactgcaggaaactccggtagggactaatgataacttgccagcatatgaggtttccctgtatttaaagcagccgttcattagtgaagatgatttaactgctgacatacagaaatatgttgatctgatgaagctgaaggtaaatgacgataaaaacgacaaatatttgttggggcttaaaattaaagtttatgatcgtaaaattgtttttgataaagacttaacacctagagcaactgcttattacatgcttaaaaaagaaagtagtaaggattcaaaaactgaggatcaatacgacagtcttggtgaccaggatgaattaatatgggataaaacattacaacagactaaaaatccgaattataaagaggattatcaattgttggttagcgggttttcagagttggatgactctcaaaaaatcacaccactttcagatgaagaatttgcattctatttaaagcttaatatgtataattctttgatgggtgatacatatggcggagcacagttgtatcttcaatgggatttaggaaggaatgtatcaaacgatggtgttgttgccattgtaaatgaatttgagaactttgaaaagcggcaaacggatattggtggattagatgattattatgacaatgttgattatttaaaacaagatctggctataaagaatccacagtttttgttgtttgctacaactaatgaagtggtagatgatgctcaggaagcccaaaagaaattaattgaatctgatccagatttgtacacacaagttattgaagatcatattcaagaaaaagcagaccaattaggggaacgtcttaatacagatgaaaaagataaaacaaagtagttaagactattttaagaagttaggggtgaaaatgtgtctaggttggctgaaaaggttgagaataatgagtttgttaaggaattagatctggcggcgcagtttttatttaaggtaaaaaacagggatccagttaaacaaagtgagttagaaaaaatggcagagagccatttagagttaataaaggatgttcaagatcattttgatgaggaaaaagaaatatcggtatacagtgaatcggatgatttgcatgaaatgggaacgttgtttcagcctttaacttcaaaagatattttatatgatgataacgaagatacagatgttgagtcattaatgttagatgaggaaaacgaagaggataaccctgaaagagtcagactagacaacgttgacaaaataatgttaattacaatcccacctttaagtgcagctcgtgagaaaaaggaaagaggtctgctacgacgactgtttagttaaaagtgaatgttttgataggtgacacccacattgttgggtgttattttgttactatgaaaacagaaataaaggaagcggggatttagatgtctgaaacagtacaaaaaattggcgctgctcttggagttaattttagtgatgagcaaaaagccattattaatcatgaaggtgcaccgcttaatgtactttcatgcgctgggtctgggaagactacagttttagttgctaagatgttaaaacgtgaaatagatgatgggataaaaccagtaaatatgttggcggtcacttttaataatcgagctgcacaggaaatggagtcgagatacaaaatagctcgccgtaaagtgggggttaaaaaaccagggagacccacgtttaaaaccttccatgcgctatttaaaatgattttggagacaatagatggatttaaatccattaaagttgcaggagatggtcagtacaaatacccgttactcaggtttattgagggtgatggtagtcgtgaaaaaactgacatttttgatgaaatgatgcagtatcgaggttggttgattaataacggattaagccgggatggtattgagaatgcgaatcaacccgataaaataacgtttaaatttgaaaattatatagccgttatggagaaatatcaagaaatgaaggatattgatgaggttattgattttgatgatatgcaaacaatacttttagatcaaattgtagatcagggaaacgaggagccggtaacagcatttagaagagttttcaaagatgtttacattgatgagtatcaagatatatcaccaatccaaatgcaaatcatggatgagcttattggggactttaataggttgactgttattggtgatgatgatcaggctatttattcttttaggggttctaatccatcttacataagggacttcacttatcggtatatgggtgcagagagattgtttctttcagacaactataggtgcaagaaagagattttagatccggttataccatctatttctaaaaacataaaacgtgttgagaaaaaagtaagggcagctaaagaaggaggggaggttgaggtcatccctttaaataactctttaagtgagttggctgacgtcattagagaggacacagaggggatgttcggtgaagagttcggtgaaataggtgtgttggttaggttaaataatcagagaacattattagcggactcgttagctgaagcaggtgtacaggttgacattggagataaacggtggtctttacggaacaacaagacatatgaaacaatcatgggaatcattaagatgataaaagaagatgatggttttttgtttgcagaccatatcaataaagtatttccgcacatcaataggtctatagctgacaggtacagtaatggcagcgggagaagttggtttgaagatgtaattgttgagaataggtacggaacacctaaagaggtaattgatcgggttcttagggtacgcaagggaaataacatgaaaaattgcattgggcacacatgggtacttatccagcagtattataaagatttatccgatcgaggttatgggtcgtttactaaacatgaaactatcgctgcgtatatgttctctatagcagatgggttgacggttaaggaattcttacattctgagaatattaaggaaaattttctgttaatgtacatggggacaggaaatggggtacagataaatactttgcacagtgtaaagggtttggagtacgatacagtgtatctagttggattagataatgatgtaattccgtcacaatccagaatagattcatttgaaagagaagggaaatttgaagaaatgaaggagtttatcgaagaggaacggaggttgttttatgttggatggacacgagccaaaagaagattggtagtttcgtataaaaagaaaaatccttctaggtttctaaaagaaattgagggattggacttacctggggtagaggatgaaactccggagacagaaaaaactaaactgaaacaagggtaaccttgtaagaaagtctaaaggatacggacatctaagccgaaatacctactgatgggatacaagacaatataatcgtgagtaattacgttgtttcgacaaagttaaaaactttttgcaaaaagactatttacaccagattacttttatagtaatatatctgtagatagagaaagacaaaaagaaaaccaacagaaacacattcacttacaccaacaccaaccaaaaaacagtaggaggcttcatctaatcatggcaaaaaaagttaagattgagacagatgtccgtaaaatgagacttagttcaggagtttcagtgaaggaggtctgtgaagagctgcatttacagagcgggtattattctgcttatgagtgcggaaatcgtcgatttgcggtcaaagagagtgacggatttgatcgaaacgaggagttcttctatgacgtgggtcatgctatcgctaaaatcaccaaaaagcgtaaagaggatgcctattctttagagaaaaacatgtttgaggacgatgacaagcttaatttaatttatcagcctttaagtgacgaactttataagaaggcattgcagttaatcgactcaggtaaaaatattattcaagcggcaattgaacttgaaattgatgagagagagttagaattacgcattaaacgtgaacaaaaatactcttctatgagtgaagaaacttactataaagcattgcacttaatcgcttcgggcaaaaacgttattcaggcggcgcaagagcttgatattgatgcacatgatttagagcaacgcattaagtacgaacaaaatgttgatgttcttacatataaaaatatttttccggatgagctacataagattattacagaataagtgtttgataaagagggtgcagaggcatcctcttttttcgtgtaaaattaaataaaggaaataaagtaacaggggtgattaagtatggggaaagtgtatgatcctacattaccgattatatgtgcgagatcttcgtataaggggaaggatattcatatcaataaatttgtggggaacaatgtgttagtttcttataataacgaacaacgctggatacaagtattgtatgaacgagtaaaggacggaacatataaccaacctgtaaaaactgttccgtatattgtgattgagaatgatgtttatcctctagattcttttaaaatgctcgggggacgatgatcgtgagaaaattaattggtaaaaatgactggggaacaatgaatctgtttaaaaaaataatgttacctctcgtggtatgtacaggggcatttaatatttgcataggtttatgggaaccggttttaactgttttatggttggtttggttctttgcctttttagttgtgtacacgaaaaaaggaagccaagaacaactaaaattaaagtctaaaaaacctaaatggcttgttgtttctggattagtattgttgtgggtcataggggcggcttttctgttcgataacattagatacggggtagctgtcagtcagattcagtttgaaaatgaagggtacaataaaattcagtctatgtttgtttccggtgacttttccgggttagttgcagtagaggttagggatgataacattactttacataagtttgatggctggaggtattcttctgctgaggacattaccgaggatgttagggaaaactccgggagaatcggtgtaaataaatgagggttttgattgaggagtgtaatgaagatggctgttttagacaaggtactcgaaaagaggggattatctagggaggatttagttgagcacaaaccacatagtctggattgggatgatctgggtcgggtagcaaagaagataggggtaagcttgttacttacggagaaggatgagcgtataggtatactgtatgatgtagatgttgacgggttgttcagtgggtttattttagaggattttttaaagcgggcggggaagagtccggttaggtacatgaataagggaaagcaacacggactaacaaaagaagcattaaagtgggttattcgggagaagttagagtggttatttgttgttgatgcaggatctggggacggaaaagctatacggtattgtactgaaaaacataatgtgcgagtcgttgtacttgatcaccatccatacgaaaaaacccatgaaataaatccaaacaaatcttggatattgaatgttcaggatgatcccaaattgcctaacctaagcggctgtggggttgtttatcgttttttggagcagttaggaagaatgtttgggttaatggtcggtcagtatgaaaagtttgtggggatcactgttatctcagatatgtgtgatatgtctgacagagaaaaccggtactatgtgaggaaggcgtatgaagagtacagggctaatgcctttttatccaagtttactttttacggttcatatcgatctttttatgggttcggagttatcccgtatctaaatgccctcataaggactggtgaggaagacagggctatgaaggttgtaaatacaatgaacaacagggctaagatgaacacaattgaaagggatcggatgagggttagggcaaaccaggacaggatgttggaggagttacttgattctggttcacttattcaaatgccgggtgtagttatgcatttaagaaaacaaaggcatgatcttcgtccagttggcggattgcttgctaatactttcatagaaaagtatagaaggtcagggttagtgttggcttgggattccgatataaaaagatgggtaggatcattcaggggaaaggactttactaatgaggagttaaaaaagtgggggtttattgcccggggacatttaaaggcttgtggcattgaggttgacaacaaaactttgaaacactttagaaaaaattttgcattctattcaaaggaaaaggcaaaaaaggattttacaacatctataacgggtttaaaaagactctcttggcaagaaatagcggactataacgagatgtccggggttaatatggatcctattgttattaaactgagagagggagttaaaggtgctgcacgaattgatgttattagtgacagaaggagagatatcatttttgagaacggtgacgttgtaactgactttactgggaaaacgactaatacgttgctagtgactccaattcttgcgagaaatgggtatcagttattacgagcgtgaggtgttaggttgagtatagaggaattgggttatcaggttagggagtattttgataagtattattgggatgagattgttcaagtagttgagctagtaaatagctatgggggtttgactgcaagggaaaagctgatgaagcttctccggttaagaataagaggggagtagcacgattaattaggggtcgtgtagaggagtgtatgaaaaggtggtttatgtggttatgggtacaagatagaaacttgtttttcaaagtagagaataatgtaataaggtattataaacaggaagcaacaaaactgattattcttcgggggtagtcgttagatagggggtcacagattggaaatcgtagagtatgcaacgtgtagtaggtgcggtaatcggtataagggaaggtttagggtagagaataatggagaagttcattgtgtagactgtgataatcccgacgtgttttcaggaattgagtggagaaaattagaggaaaattcaagtaaaattgagtttgatatggtatccgatatgttaatgtctgatattgaacgcatatatcagttgcatgcagaaagagacgagaatataatggctcaattttataaggaagatgggtcgattaatttagacaaagtgtactttatgggaaatcctttagacttggcttccgctgctcagagggttgcgtatgctgcattgcagtatttagagactcgggatactaagtatgtcggggaagctgaggatatcgtcgagagatataaagaattgcgtgagagaaagttgacagacgaagagattcagaagttttgggaggatttattgtctgacagcatacaagagattgccggtgaggaagggttgtaatggaggagcgggtatatacgattggcatgttgtttctatttgggtttgaattgattttttctatccctttaatgacagattctttgttagattccgatatgtcatatcttttaatggtgttaggtgcgggtcacttattttggcttatgtacaccaaaacaggtatggttaataatggggttgtggcacctcacatatttggttctctaggtgtgttgttctcgatgatcccattgtttgggtttactgttcattttattacctcctggatgatcgggaaatttttgatagtagagttccgtggagggaatacaaataaaaaaacaggtaataataaaaataaactagctgttgtacaattgtttggaaaacccctgacaaaaaagcaaaagaattaaggcactcggcaccgggtgtctttttatgtttgtggataattaaagatgagtaataaaatgtcgattcaggtaaacttgttgtagtaatttgattagatcggagagcgtggtggggttattgttttcttggagagcgtggatggttgcggctgctgggggtttcctgttaacgttaattttatcgttgtggggatcatactgggttgtaaatgggaatgaaaaagatcttaaacatgatgttttagacaaggtgagtattactggtaataaatcaggaacttaccattatgattggaataaaggaaataatgggatcaatctagaacataagaagtatagagatgtggtagatgaattaaaatcaggagagtttacattaagtaaaaacggtatagtgaagagaaccgaagttctcggggttaatttttattgggttctcgattacagttggttaggtaagggaaaagttaataatgtaaccattcagaagtatgtagaggaaaacaagggattgatggtggttcggactttctggttgtctgggagtttgatcgaatcggtagtgtttatttcaattttgtttatctgcggagggtactgcaacaaattaatggtgaggttgttgccggtatttattgcgaagcgtggaataacattagagagtggttcagatccagaaatggtggagaatgcgtatagatctctacttaaacggagagtggtgaccagtcatgagttgaaattcgtattaattgtgtacggttctctcacatcgttaataggggtacttagtgttgacaaagtagacaatatgggtgtagctgcagtagtagcatacttagttatagatttgattgttgttgtttatcttgcgtttgatgtgaagagagcgattaaaacagtaggtatgggaaaatagaatttttaatacgtatgggatagtgatggggtgaaatattccattttcgaaatataaaaatgaataatatcgtataattaataattgccacactcatgtttataatcagagacggatgcagccgtatctaaacgagtgtggttttttgttgagcgggagattccaaataaatgtaagtgaggtgataaaatgaagataaggggttccttactggaagaggggaagatgcttacagatgctcagttaatacatatacaagagagggtaagaacattatctaagttattggacaagaagttgagtccgtcaggaataaagtcttcacaacctaaaaaattggcaccgggtcttgttgggtttgaggtattaggtacggttggaaatatctctttagttagagtttactttagcaatctaaaggtgtcagactataacaaaatggcaagaacaataccttctcatgttaactttgtttttaatgagaggagagatatatggattgaactacataagtatgaagattggtttgaggtaagggacggggtaatttataaaatattgtatacagttaacaagtttaagtgagtggtaaccccgctcactttttttgtggaaagataaagttttgggagattgtttaaaaggagagaataaaaaaagaaggggatttaaatggcaactaagagagaaaaggtacagaaaaacttggagtacatgaaagtccaaatagaaagatttttaaaaaagaattacagaattcagttcagaggtaaggtcttcgctaataagtcactctacaaacagaatcgttatgggatgacaacatttaaatctggcggggaatgtgaagttgatattgcttatgatgtggcagcgggaagtgataaaggctttatgctgcagacggtgtttagagaggcggttcggattggttgtgccttgaatggaaagcggtacatggatggggaggatgattacgaaaaggaattaagcaaatatgggttggtaagttacgggggtctaccagaacggggacttgatttacacacgtatagttgttctgagtgtaaaaaggtgtggattctaaagaaaaataaattatcagttacaaaggatcctgagcaaacgggtatcctcacaggttgttgtaaagccagatttaagtatgatgggaaggtttattacagcaataaggatttgcagaaggttaaaaaacgttagggggatttttgtgagtggacgtcgacaggacattgagaaggttagaggggagaggaataacccaaataggagggaactggctagagcggaggatcgattacgggatgggagaggtactaaaaagatcaagtctaaaagagtaaaacctgtagaggaggcaggtaaaaagaggttaattaaaaataaagataataagaccactattgatgttaataatgataatgaaaataatatcgatactaatagtaaattgaataatgttggaggtaacatcaggaatcggttaaagtttaacccgtttagtttaaagcagtctcaaaaattcatgatggatactttggttgatgaggggttaactcaggggaaaagatttatgccgggcggtgcagctgcttcaaaaacgctggatagagtggtgggaacagacaagcaatcacggtttataaagaagaagatgccaccacagactaaggtatttttgtgggtatcagggttattagttttttgtttgtcatggttgtttgtaattattgttgtgatgataattgcgttcggggctgcggcagttttgatggatgataaagataaggagaacagcttacctatctacagggatcctactaaggtgttagtggtaactgatgaagtaacgaagtctatgtctgattttgataacaagccacataggatgtcggataaattttgttaatattgattttaagaaggaattaatttgggggagttttaaatgaaaaaggagcgggagttattcgggagtttatatcagaaccgcaaaaattggggtcaatatagtaagggcgagttagattttatggagactgttttgttggatcttcaagctttagttgttaaaacaggactttcaattaaaacgttggagagacaatttaaattatcaaaggaagacctgttagattttaaaaataatcataaacagatattgaaagaaattggggagcttaaacaaacggctggtgatggtagtttaacatttacaaccgaccgggttgctgagattttgatagataactggcaggaggcgctgggttattgtagagacggttataatcgagaagaggtgtgtagagcactcggaacaatttttaatgaaccggcatggaacaggtttttaaggaagatgaatcgaatgggttacaaggtaactaagatttcaaaactagatcgaattttggatatgattgatgccggcgaatctttagagacgattgtgaaaaagtatccggattttaaaacagcagaagattgtttagctttcttagaaaatgaaggggtacctagacgaatgattttgcgacaagagatcaggaatgaggggaattcctctttttttaacggatacagtggggctgcttatgcctaacaatagagtatccagttgcagcagataggttatgggtaaggggtttataattgtgttggaggtgcctacttaaagaggaaatattgaaagcgattaaagaagccaaagatgattttgggattgaaatcaatcctaatactgttgattatgaatatatgatgagaagtattaaacgggagtacttcgaggaagagattaaaaataagccaattatggtagcaagtaagatggcggactctcagataaaaaatttaaacaaatttagggggaacaataatggatattcaatttacgaaatttagaaaaggcgaattatgggttgagggtgttgtagacaagggtaagtattcatttatagcaaagttgtttgatgataagagtgctgatttaggtattcaaggtggaagagtaagtaaattagctatttcaatcggggaaaaatggactgggatggataactgcgtagttaactatgatcgtggttgggatattcgcccaggtaaagagtactacaatctgtttaaatctgttttgaattttcttgaaaatgcgcctaagacaagattttaggaataataaaaatataacggggatgttggtggtttgaaatagtggaaaaaattaagttgagtaaggaatctgaaaaagaaaaacgcatagaccgggataaggttgttttgggattagtgatgttaccctttttggtggctatggttttatcggctacatacggaactaagtttgcggttgacaacatgaatgagcagcacgaacggagagaaaaagttgaagcaaaaaagtacgatctgttaagtaaagaactgggtgtgggggagaaaaatataattattgaagaacaaaagtcaaaaaactacgatctggtattaacaagtaaaggggattatagggtcgtatttagtaatcttgatgatccagacaaattaaaacttgaaagagtgttgaaagattaattatcttggggtgcttaatttgaagactgaggaagataaagagtcaggaaacaagtattttgatcgtgcagcaggattgatattgccgttagggtttttattcggtttgatatgtatgttggttgatgggtgctcatttgtcgaatcaggtgcagaactagttaaagaaaagaagtataagttggtcagccaagaactggggttaagggaaaaggatgttgtgattgaacatggtgatcgggggacggacaaggtgttaactaataaaggtacatataacgttattttcaacactgccaaagatccagataatcttgaaattaagcatataagcaagcattaaaatactgtcagggggattattaagttggagagtacaggcaaggtaaagaggtctaagtttggtggtgtaaacccggctgctattgcgttggtcattgttcttatttttatatgcgttttaggtatagttttcggagctgagttgggaactgtatctaaaaaactagatgagaaaaaatatgaattggtgagtaacgagttaggtgtaagtaaaaagaacattataattgatgacagtatttccgatgattatgttaaggcgtctacagacaaaggaagttataaagttattttcaaaaatgaaaatgatccggataaaatagctattagcaatatagtcaaggagtaggggtgtcggtaggtttggtgatcaaaaagaattgctggggtgtctaatcttttcaagcgaccttattaagaaggtcgttttttatttgtatgataacaaataacctttatagcgattgtagttcagttaagatatttataaatatcatgtaaagtgtataggggtgaaaataatgaggtttggtaaggtaaagggagatcctgtgggaattatgtttctgtatgggagaacagagtgcatggggattaagtatacggatggggaggctgaaagggtacaggctcttcatgggttaagggagagtattcaggaagatgatataatgacgatgattgctggagaagacttagagggtaaattttctatttgggaagttcaagctaaggttttaaaagacggggtgtataaggggagtccggcattcatccgggatttccgagagatctgtagagggacagatgtgattgatatgagaagaacttttttaagtatggtagatgaatataaacaaagaacggttgcgctgcagagcattagttaggtaactggattagataatggaggtacagaatggctgaggcattaaaggaacgagaagtagttttaaatgaatataacgatgattcaattcaagtattagagggtttagaggcagtaagaaagagaccaggtatgtacatagggtctacagatcgacgtggcttacatcacttggtatatgaaattttcgataacgctgtggacgaggcacttgcgggattcggatctgaaattgtagtgactttaaataaggatgcttcggttactgttcgtgattttggtcggggagtgccgacggggatgagtaaagaccgtggagtatcgactgcagaggttattttcacagtacttcatgcgggaggtaagtttggtcagggagggtataaatcatctggaggtctacatggtgtgggatcttcagtggttaatgctttatctgtaaaaatgtccgttcgtatttttcgagatgggaaagagcatttaatcgagtttgaaaacggtggaaaggttaaaaccccgttaaaggctgtagggaaaacaaaggaacaaggaaccgaggtcacttttcttccggatccagatatcttttcaacaacaaggttcactttcgacacattatctgagaggttgcgggaaacagcttttttaatgaaaaatatgaaagtaacgttgagagataatcgagcagatgaaccaaaagaagaggtttaccactatgaacgtggtttggctgacttcgttgattatttaaatcaagataaggatattgtatcgccagtgcaattttactcaggggaagcaggcggggttgaaatcgatactgccctacagtggaatgaggggtatacagaaaccatttatagctttgttaacaacgttagaacaaaagatgggggaacgcatgaaacggggtttaaaacagctcttacacgagcaatgaacgattatgctaagagtaatgggttcttaaaaccaaaagacaataaccttgaaggtggagatattcgtgagggtattgtaggtattgtaagtgtgcgggtgccggaaaacatcttacagtttgagggacaaacaaaaggaaagttaggaacaagtgaagtaagatccttagtggacaatttcttctacgataaggttacccaatatatgcaggagaaccctaaaatagctgaacatcttataaaaaaggcaattaaagcgcaaaaggtaagagaagaagctagaaaggctagggatcgggcaaggaataacaaaaagagtaaacgccgacatatcttaacggaaaaacttacagatgcaacaagtaaggacgtttccgagcgtcaattatttttggttgagggtgactctgccggtggtacagcaaagaaagcaagagatcgtaaaacacagggcattctatccttacgtggtaaggtactgaatacagaaaaggcgtcattaagtaagttattgaaaaaccaagaactgcagacaattattcatgctgttggtggaactggtttaggtgaggaatttacattagagacggtaaactacgacaaaatcattattatgacggatgccgatactgatgggtcacatattcaaacgctgttgttaacgttcttttatcggtatatgactaagttgattgaggcaggaaaagtgtatattgcattacctccgctttatgcggtaaagaaaaaggggcatgaggtacagtattgttggaaccagattgagttgtcaaaaataacaaaagagcttaaatccaattatgaaatcaaaaggtttaaggggttaggtgaaatgtctgctgatgaactgtgggatacaaccttaaaccctgaaaatagaacattaattcaggtgggattagataactttgttcaggcagataggacgttttcaacgctcatgggtgatgatacagatgcccggaaacgttggctggaggaaaatgttgattttgagttagatgagtgatggggtgggttttcccacccttttcttgtatggggggtttggaattggtagtggatatagtggcaggtatattggagactattttgtcaggtaatattttggcagaaaggttgcccgggtgggaaaagaataagaaaaaggaagataagaagtaagggggtctaaggttgaggttagttatgaggaatccagtagataattgggaaaagttaaaaatagggagaaaatacatttggttagagagcggtatagatacagtggttcgtgttttgaggaaaaaggaagatggggattggtttggagtaacattagaggtgataaagagtaagcatgatcagttacataaaaaaggagatacgttcgatgttgggtaccgcagaggttacgaacactaccaagttggggagttttacaaagctggagccgtggcaaaaatttaaacagggtgacgcagttacatggaaagatgattacgggtcatttcatggatttgttgcgagtagttgtaatgtggggacagggttagagttgaggatgaaggtcattacgggtcaaggtttctacggggcatatgaggggaaggaactattggtaggtaaggattacggttttgtgcatgaagggaatttaataaatggttggatttaaataaaagatctcggaggctatatcctctgagatctttttgtatcggttagtctaccgataatactccgtaaccacatggataccagaatccgtttgcagcacgagcccatccgtatactttatcatttccgttcaatttagtttgaagctctttcagggttagagtaactgatgttgtgttcccaggttctcttgtacggatcgtattgtttaggtctacgttaggctctccaccagttgtccaagcaattgctttgtagtatttgcttgtaaatgggttgtctaaaccgccgatcgacagggtaacttgagccccactcacggtaacgctagtataagcggaactggctgcaggtttaaaatttaaaatcttctttgctggtgttgggtgttcagccgccataacacctgttcccccagttaacagtaaacctaatgctaaagaacctgaaattagttttttgtacatagatattccccctttaatattgttggtacatggtgaatattccccgtccatatggaaaaaccttcttgtattttacagattcacacaatttacacaactttaataggttaataaaaaaaggaacaaatgataatgatgcaaaccagataaagttcaaggaaagcaaataagttaaggtgtttagtttaggaggggtaaggaatggatcgttggggaatgcaggtaatacggattgaagcaaataaaggtgactcggacgagtttaatattcaatcgttacaaattagagatgggaaagttaaatatcatgagggagaagaattaaaaatacaggggaagagatatgttgtagttcacgatgatgggtttcatgtaaatgtctatgatcctgattacaaaatttcagggacttgggcgtatgttatggctaccagtgagaacgggtctagtgtagggagtctaggaagtgaagtatatacaagtaagaaagaggctattgcggcagctaagagagaaaaaacattaacttatggtgaagtattatatggattttggttaggatcagtgtccgatattgatgggtatcgaaaaaagatagagtttacggatttctacggtatggatgggaaacagagaggtggtcaagggttgagtcaaaccaaagaggtaaatgtacagagtgtaattgatgatgtattaaatgagattaaccataagccggctacacaagatgcggcactttatcaccggtatgcggtacaacaaattatccctgcatatgtggatggacaattaggtgctagagtgttgattaaacaatttagtggtaagccgttagcggatgtacgtgtaggggttttaaatgagctgcaggcaatctatgagagagagtttaaaagggcacagaggcacggtgttgttgaggattttgatgatgttaggttaaaagaggaatcggaaaaagaaagaaaaattgtttatgaaaccgctacacagactgctataaaagtaaggatagcattaaaaaaggcatttcctcatcttccagcaagacactttaaggtaaggaaggatgggaactctgtccgggtgaaatggcaggattacccgatggaggatgaggtcgataaagtggtgaaaaaatatgaaagttctcgttttgatgggatgacggattcaacaacgtcaacgccttatgaggaagacggagtattatatcatggtgcagattatgtacttactgaacgaaaaatttcagatgaacggcgtaaggttcttcggtcaatctgtgagaatgtatatggggactggaatactcttgatcgatttcagcagtggaatagggagtcgaagattgataaggatattgatataaataacaggtatgttggtgaattagatctgtccgaatatggtttagacgaccgtggaaaacgagatgtggttagagaggatgtcggagctgatattgccgataatgttatcaaagaagcggtggaacgggtttatagtcatttaaacaagaatcctggaatcgtaaagaaaaaggtatttagagaatactcggcggacaattattataatcggttaatagttgcaaacattaaaatggatacggaagaacaagtgttttcggttgtcgaggattttctgaataatgaagttaaaaaggatgttgggaatgttttgtcggtgtttaaatcggcattggaaaccgcagttagcgaaaaaacatgggcagcggggttagacaatagagatgaaattgtgaaatatgttctcagtcaggtaagtgaagattcaattattaggtattcgaatgaagaagggtatagggatttggatacattacatatccgatatgcagaggataagattgaagagtatttatctaaaaaagcagattctgatgagtgggatagtggagaatcaatgggacaagttaaggtgttaatggaggattctattgatagagttgcagatcaaaaaatgggtgagctgcaccgatttattgttagaaaattaaggggatcaaatagatctttggcaacgaggattaaagaggatcagagtttaattgcatcatttgaggctagagcggagagtgatttacgtttaggtgtagatataaactcttgggttgatgattattttagaaaagccgcagataatgtagttaaggaaattgaagaactggttaatcgtgatatactagatgcttttgttaaagaggttaagataaaaggaaagcaagtagaggatagacaacttttgaaaagctttggggcgtttattggatcctcagataatattatttctcagatcaaagtgagacctagtagtgggaacttgacgattgaggatgagactaaacggtttattgaagaaaaatgggtcgagttccaacggggtgaagatcaaaaatcaaaaaaattggaaagtgtaattaaaattacacaagaagataaaaaatatgtattggagaaaatagctgaagcagtcaggtcagctaatgatagtggggttcaaattacggagaaggatttacggaaaaaagtaacaccaaaggatgtagttaaactaaaacgaagtgttggcggagatgaaagtaaattttatatcggggtaaacaagttaattgagtcggcggttaaaaaattatctgagagtggatcaggagagtttagtgtggatgatttgatccgtgggttgttacttggtgaagtcaaactggtttttagaaaggtgaatggtgttacccggaaaatggttgctactcggaatactgaattaatatctgattttgatgaggaagatgcatttgtttttgcagattactataatcgacaatcagaggttaaaaaacaggtgagtggggggacgatcccagtatttgatatggaaaagggtgagatacgctcatttgtactggatcgggtgatctcttatcaaatcggatccggtacccaagcagttaagggtatatctcaaaaccaaaccccagaacctaaaggaagatattttgatccgacggatatggaaacgcaaaagataattaaagttttagaggataaagttgtaaggttagtatttgagaaaaaggatgggtctaagagacctatggttgcaacaaggaatcatgatttaattgagttatatatgagtaaggggacttctcaattaagtgcaaacagtactcagattgatagtatgtacgaaaaaatccaagcgcagattgatggggattatgtaaaagtatttgatctttcaaagtgtgagtttcggacgtttaaaccatcaaaactgttaaattacgattttgataataacgttggttcttggttagagttttcaacggacaatgatgcttggtatgatatcgctcaaaatggtgaaaaaccgagtaaatattaccgtgaggggagcaaattagcagttaatattggtagatcattatccgaacggttcaaattcgagcagaaagctaagagggaactcgatgagttgctatacacacgaaagtctctggagaagcaaaaagagcaagttaataaacaaaatcttaaagatggggaaagaaaacaacggttggggttagcaagaaagcagcttgatgattacttgaaaagtattaaaggtgtcgacttcaatgaggatttcaagcaaatgtttgagcggttgaaaaatgttcctggggatttaaatatactgaagtcaatggagaatatggagcagttagctaggatagttaaggtgttggagagcagtggtgttgttattatgagaattaatcgtgcttatttctttatgcatccatatttcttggttaatgcttcaagtggtcgagtgtacgtagataagcccggaatatttaaacttggaaaggttgaattaatggatgaggatgtagctgctgaggattatttaactgaaattgctgaggatattaaaaaaattaagcggcgatccaaattcaaaatcacagcccttgagggtggggacgtaactcgattagagaggttagtaaaggtggctgatactcacaaagaagatgcggccagactcggtattcggtttagcggtatttctaaaacagaaaaattgccggagcatgtagcggttacttttggtcggaataagtggctaattagtccaaagtttgtatgcgatattacaacaggggtgccgtcctacattttcaagaggaagaaaccaaatgctacgttatctgagttgcaggatgcgtttaaggagatgaatcttaatcagagaaaagatcgtgaccagattaagtgggtggcaacaatcattcaaactgcttttgatctaaggaaaacagttaggtcgtagggtgtgggggcttaggctcccacatttttattatctcattatatttgacaaaacaatatataatatgtataataaaaatatattattgaatagggggaattgtatggtatccgacaaggtggcaagtttactgagggagtacaagttgaaattttcagggtacattaacgaacaaatgaagtctgggaaaagtttaatagaatacgatttcactgagcagactgcaaacatgttaagtcgaatcgagaaagtaagtaatgatcctttaaagattgatgaattgttaaatattgagaagattgtgattgaggaagaagggttagtagttgtacataaaaaaggaaaaccattcttaaaaaagaagggtttggcggggcgtatggtttctaaaatactgagataattggttaagaaagaattgagggggataagcatggttagggttaagtcaaataatttacataaggggaaacgatgggatgaaggattggaaataagtaagttaaggtatgttgatgaagaagatgtaagggagccaatctttgatgcaatagcgtgtaaagtgttttatggggttgttgtaattctattggtaatgatggttgttttacatttagtttaaataggatcttagagagaaatgaggagtttacattggcagtacttaatgggatagagattagaggagttaaaaagaggttgggtcatgaggggaggagcttccttatggtaacgtgtattatttaggtaagcgtgtgggatactttgagcttttagattggggggctggatttacgtatacacataccagtgcagtaattgatgaagataaaattataacggaggcaacaaaagtacaggagttaatgggttggcatgagaagtataaagagttagacatggttgatgttgtattaaatgagcttataaccttcaaggatgaggaaatggagttcaaaaaggcaatcaaaaaaggatgttactttgtcacaacgtatgaagatatgtccttggatccttatgaccatcacccgagtaagttaaaaagatattatacggttcctgtggaatttaaaaatgagttggatgaattagttaatgatttaaataaagagggatttaaggtacgggtgtacagatcggaaaaagattttgtgaagtgttagatatcgggtgcgggtatgcacccttttttgatacatcaatcccagataatactataaccgaagtataaaatagatataggaattcattaaatattaattgaggtgggtattggtggatcttattttagctttatatattttaatggctattacagggttgatacctattatagctagtattgcaacgttcacagatgtatttgatacaataggtgatatctttatctcaattgctgataaaagtacattagcaattgagaaggcttttgatcggaggagtcttcgtaaaaggtctagaatttctagaaaagaatttcgcgactataaaaagatggttcggtctatattgaagcttgaacataaagttgaaaaaataagtaataaggttgaacaaaggtatgcggtggttaatattggcgatttaaaagctaaaatagggttggttaaaaacatattgtctccccatgggaaaaggaacggaaaaaacctaacaattagggatttcccagaatcttattggaaggtaaaaaatgttttgatccggtatgaggtaacattgtttcaaattgccggaagatattttcctctatttgatcatgaaatgactctggatcacgaggtacatatcggtcggttatcaaaagaatttggggacattattgatgagctgagggttgatttgtgtaatgagattaagcctttccgagactataggagcgctattgtagatacagatatacagggcgctaaggatacgttaagttttgagaaggattatttaaagagaagtaagggcgactattcaagtattgatttaaacaagagtaagccggctgatacgaaaaaacaatcaacaaacgaacatttaggtacagcatcactattggctgcaggtgttcttagtggtggattggattacggaagtggggataatgttagtgaccaggtcaagcctgagagttcgagttgtagtgggggctatacacattctcattcacatagccactcggattacagtacgggacatgatactggtggagttgatagcagcggatttgacagcgggtcattttaattacaaggagatgttataggttatgagttgcaaattgagggatcagtatacgaggcaagcatttgaagttgaggatattgggagaagggataactatacgttcatttataacccctacgatcagtcggtagagacatatgacacttccagaaaagatagtgggttgggtttcaaacgaaaattagttggaagatcagtaaaagaatttccgtttgaatgtgattctgcttacagttactttgtagagttatacaggaaagctactttatttgagggtaacaatgatatttattttattgggtgggttcatccagatcacgggtacagtttagatgaagagccggtggaggatataaaaaagaaaataacaaatttcaatcttatacgagatgagttacgtgaaaagtacgatcagttagcgggatgtattaaggatccagatgtgaggtcagtgtttagacagcatgtgtttattgcggggggctgcatagcgtctatgattaggggtgatgagcctaaagattttgatttctttttaaactcgaaagatgcactgtataaagtagtcgaatactttgtaagtcaacataatcaaagatcttatgatgatagcgagttaagtgtaagtgttggtgatgatggaaaggttaatctttctgtaccgggaggttacgtaaagatgagaggggggtcaaaaactgatccggttagctttagtccaaccgctattacatttccaaacgatttgcaacttattgtggtcggggcggagacagaaagggagatgataagcaaatttgactttgtacatactatggcttattacaagccgaacctggatgagttttttatagatgaggatgcgtttagtgctgcgtcagataataaattagtctataacattacagatcctaacccaattggggcagcaaaacgtttgttaaggtttgtccagagaggctgggaaatagatcataaagagcatatgaagatactgttgaacgtgaatagagttaaggatgagggatcctttggggaattaaaagaatacacgtttatgtagggtatataggaaattataaaagggtaaagtgacgtaagtacactttacttttttatatatttatagtataattaaattaataaatacatagataggattgtgatgattaaatcaatgggggaggacaacaggattaattgatgtttggaagtatttactgtgcattttacagatcagtatgagaatgtggtaaagaaaataaggctaatggtggaaggtttaagcccagaagtcaaggattgttgggacaaagaggaggatagaaaccacaaaaagtgatataccgaagtaaaaatgatgtgtaaacctatttgcaattgggtgtatacgtgggaataaaaaagactcacctcggtatgtattgttaagagacgtgtgagttctgttatttaacgagtactgtagttgtgggtgatttttaacttggggggttaagcatgaacgagtatagagtgtgggacgggaagaagatgtattattgggatgatggggaattgtatcttattatctcaggtggagaatggggattgtaccggaataatgtcacatctctacatgcgagtcttatagcgtctagtaaacaaagaaacgcagtccttatgtggggaacgggtcgaagagatgaggaagggagaatgatttatcccggtaacaagattgaatattacacagaggatttttctattatcactaaaaaggtaaggttggttaacacaatcgaggtaatcgatgggttgcacaatgttcccggtgattatgcaaagaacatcagaattataggtgatgtttatgagagagtggaggatgcggaatgaacacagcatggagagtttgggacggagaagggcgtatgtattattggaacgacttagggatgagtcttgaaataacaggagacaaatggtttttatggcattcatggggtgacggtagcagggcaaaggttgtagaaagcgatgacaaaggtgcggctctcatgtggcacatagggtcattggataagaacaataaagctatctatgaaaaagatatcgatatgttagatgaagaaccgatgatcgttgtttacgaaaatggtcattatggacttaaattccatgatgatagtgcctatttcgatgattcagtagattgggaagaatgcgacatcggaggcaatgtttatgaacatcgtgtgttattggagggtgcggagtgaaaatacccaaaaggatagagagagccatcgaagaagcgtcaatacactttgagatagctgtcaagcatagccatgaaatacgcaaatggctagaagaaagaggaataggaaacgatacaacatttgacatgttaattgattgtatcgaagaaggggcgggggatggagaagaatttaaggaatttattgaaagccacacaaaaaaagaattgacgcaggaaaacagtcttttttaagaataaggagggtgcggagtgatgtacaaaagcgggagtgtttatctaacaagtaaggacaaagaagtgattgacgaattaatcgaaatgtacgttatctcgataaaccccgatgaagaaatggaagaaggaatacgtagaataagggataaaatcggcagccatcatttccacagacgaaaaacaaataaggagggtgcggagtgattgaagttacggtaaagagtaagattagtggcagaataaaaagaggatcatttactgcaaggcaactactagatacatatgaggatgatcttgtttgtaacctgacgaaatgtgattgtcagccagtgggggaaacatacgtagtagaatgcaattgttgtgaagagtgggaagaatatgaattatcttttagtgatggatattaaggaggtacatagtgatgcatgctacatacagagtatggaacggtgagaagatgtactattggaatgacaatgggttaagtctcaccattaaaaatgatggaagttggctgttgtgggaggatagaaacaaaatacatattgttgcgtcgagtgatgacggaaagtcagttcttatgtggggtagtggggtagcagacgctgcgggacgtttattttatgatgggtcgctgtttaaagcacctgttgatattaacaaccatcgtcacggtagttgggttatttatgaggttgtttatagaaatggaacttgggttgctcagtatgtggtgagtgaaacaggagttgttttgccaagaggttatgtagcccgagaattaattagttattttgatcaggaatcgggggatatagtgtttgaggatgtgtgcctaaccgcagataaaaccagcgcagaaatagtagggaatatttatgaagattacaatcgtttggttgacggctgtagggaggtatagatgtttacttttttgctgtatatcggtattactgttttaagttccattttcttttataaattgtggaatagatttttaattggttttccgattaaggttaatggagaaagtatagtaagctctaagtacagttccgaaattagtttggatgaaaggatgtctggggcgcttacaacacgaggagcttttctaaacctacttttctgcttaggggtagcgtatccattactgtactctatggtgtattcaatgggttctgatgggttggaggggttaatagtcgcagttatgttcggttcaaagtttttagatattagggttatttatggtttgcttatagtcacattttgtttcacattatttgaacatataaggtttcgagttcggtttaagattaaccgggttttacatgatgagaataaataaacgtagtcgacgggattgtgaaaaagtcaaatttgaattcagatgggtggcgtgttaggtgagtgaatttcggggacatacattggataaagttcaggctgcagcactggacaaggtaatagaatatatgaaatatttgcatgatcttgatgaagaaggagaagatatgcaggacaccgtagattcatttatccaagaaacagaagcatttttatatgaattgggagcaatcaagaaaactgtgtttagctttgagggggtacggagtgatgagggaagagaaaattgattattgggaaggaaaagacgggaaagttaaagtgatcattactgatttattaaaaatgcgtccgtacacaaaaaagggaaatagatctcctgtgagtctatttgattttgacggtaattaccggtgccgtattcttcacatccagaaggatatgaatttagttaggcgtatttttgaggcgcttgaagccgatgataggtttcagaattttaagctggggtttgataaagaaatcaatatgtatgaatttacgataaatgaacatggagacatgccacatagatcgtttaatacaatttgtgtagatgcggttatcaacaccacatacgaggcattgatacatatgaggtacacaccagaaacaaaggttaggggtgtgtaaattgagtctatcaaaattatggggtggaggtaccgaacatgtgtaaagtagtcacggttgacgtttgtatgaactgcggggtcaaactcccaaatgaagtggaggcggatatatgctgcagtgggtacatgtgcggctgtcaggggttgccggaaccggttttttgtgatgagtgttctattaaaatatttaatgggatcggttaataacagtttaagaggatccgataatagggaagagttatttaaatacggaaacgattataataagtgaagataaatatgtgagtaggggtttgactaggtgaaagatataaaagacagaaaatcatttcttatgaaagaactgttaaggtttagagagtttaaagtaagtgatctaagttggttagagaatcttagtttggctgaattggaaaagttgcatattaaagttaagtgtgagcatggaagattaataaaaagagaaatgatcaattagtgtaagggttgcgaatttatgcagcccttaatttgttatcggataagtacaaaaaagatttttctttatctctgtgtataatagtcattaataggatcaagatttttcacaggtacgaaggtggttaagttgaaaaaagcgaagttagttaaagttatgtattttaaagacaatggggatttttatttagctgatgatgagttaattgcggatccaagagattatgaggaactcgttgaagtaataaaaacacggagaaggtttaagggaatgacaatggttataagtgatggcggtgacggtgtatatccttatgtcaaaccaaggttaattaaagatgatactaaagaggaaactagaggcttttttgggtgatatactggtaaaaagagtaagggggagaggtattgagaaaattaacagacttggtacaaaacagtctaggtaaaaaagataagtatgataggaatgttcaggttacagagtttatgaaagatggcatctacagaaccatgagtaatggagttttcgtagcatccaagaaggttcacgattactcagaccttcatcttttcgggttgccggagggctttgagggggttcgcttactgattgataaaatcccatttaaatattggatcatggttttggacttctataaagatgtatatgagaagcatggaacagaggcttcggtattgttttattataatcatgcggacttggatatacctcagtattatccggatggaatcatacaagatgggagacttatcgtttactgccccaagcaaaggaacacaggtgttaggagtaaatttgatgatgagcagatgcgttggttggaggataatacataccctattttagagactcacagtcatcatgtaatgaagacattttttagtacaatagatgatttaaacgaacaaagatttatgttttacggtgtatatggggagatcaatacatacgacaattttaagttgaggtacatgtatcagggtgagcatgtagaggtaccggctaccacattatttgaatttccggattgggctagtgatcggggagatgtaaatgacaatgaaaaggtgattgacttagttgatattgaaaagggttgttttaaaaacacacattcatatccagattgctggtttaatcaaatagataggagtgttgatttagatcctgtggaaatgagggtggtcatgtctgaggaagtactttattagttggggggattaagataatgaaagggtgtttagttatggggtcaccttataggagtgttgatatttttaaggcacttgaggaggcacaagttgaaagggttaactccattgagctacttaatgagttccacaaagtagggaaacatgttttgggaaagaaattgccgattgctggggtggtggttagaaagtctattggttacttttttgatgaatctacggttaagtatagccattaccgaactttatccgatgaggaaagggaaaacgaaacaattctaactctagcagaaggggaaaaaccgtatgatgttttaaccatagatgacggattaggggaaacagaggttattgtaaaggatagcacacaggttaatggggatgttcgtgtaggtgatgttgttcaggctacagttaggtatttagcggatgcctgggacgtaaaggagaggaaggcgaaagaagagtatttaagttttcctacgttgcgagagaatgtagatcttgatcgtcatccttacaatcctttacgagatgtgtatgctgcgatcagtatcgataaacttccgatagacttgcctgaaccagtttaggataatgaataaggagtacgaattgcagttaactattaaagtttaagtatacttaaaattaaggaggacaaagttatgtcagttaaagaacaaacagtaactaaagttgaggttgccggagaaacatttacgttagataaaccaactaatcaagagggtgtaatggagttgctacgagaattaaaccttggagatcaaatagagggcgccacagcgtctgttcaagacgatgtaatggttttctcctatccacaaggagataagggttaagagtttatggaggaaaacaggaaagaagtttatgtacttattgatgaaaacttaggtggactttcccgggaattttttgaagtaacaaaggaagctcataagggtgacttaattatttatccggagggggcttattatttttcccacggacctttttacagagtttctaaggtatttgaagatggaaaagttgcagtggaggatgacccagatcacatagtcgaactattggggtacaaggtattggaaccaactaatgtgattcatttaaaagaccagaggtataaaatggttgaccgtaaagcacttgttggtgacaatgtagttatttgtgaggttcatgaggatatgggtaccatagacgaactggggaaaacggctaaggttacagaggttcgggatagtggacatattgacacagctgaattgggggtcgtgttaagatctgaatatcgggtacttgatttactaggctaggtcaataaataggaagataaagttaaggagggtttaatccctccttttttatttataattaattattgaacacaaatatataattgatagtgataacgatattgaatgtgtttattggtttgataggagggttttaatcttggtgtactctttgagttaagataggtaaaagagaatcggtgtagattacaaataatatgatgaatttagggtggtgtaggatgaacgaggatgattcaattaaagaaaaaatgtgcaaagtcgttagtttattatcgaatattaaagagtttaaagtgcaagatgctaagtcagataaagacttatggctgcttcaaatacacgactcaaaattcatgcctaatgcaaggagtaccatttataaaaataagcagttaatggacactattcgaaagtctggggataatgatttattttagggggagtaaacaatggctattggggggtttagcaaacttaatcagatgcagaggtatggtgacaggtcggaaaagatgcctgacttaattgggggttgggataaaaaaacgtttaacaaggctaaggacgtgttgaaggacgttgaggaaagctatgttgaatactttgaatttcttgatagttgtgtagatgttacagttttgagaggaagtccagcagcaataggaacacaaaaatttcaactttcctatcaggaatttaatcaatatataaagcctggaattacaaaaagtaaatcagaggattcggagcttgggtttttgtctgatttcgtgggtgattctggtgcgtatcatttacctgtaggaacgtatgaggttgagaagatagctgaggggctgcttattcgggttcgtgttggagatccaaactggggattggttagtgtgtatgaggcggaggtacgaagtggcggcataacaaggattccatgtgaggctgatgttgggtcagtttatgttgttgagtggttactgaacgggaacattgtgaatgaagaaaatgctccacgagttaattcggtaaagaagtttattggttcattctttccgctaagaacggatcaagattttgtggacgttccctttttgtgtgacaaattaaatcgagatatacaaaacaactggcttaatggtgggaataagaaaaaatggattaaaagatgggttgcgggtgtagattcaatgttagcagtagcgactaaagaagatatgcagaatgaagggtatagaagtgaaatacttaggtcaatagcacaaaaaacacagattgattggtctaaggttaggaggtgagtgacttggcggggattgcagatttgcaaaatcgtgatacatacaatgtatttaatgataaagctgtaaaaaacttgtttgttgtttatggattaggtggggtggcttcgcatgtattgtaccaattgttgttcaggattgaaaatttggaacaccctactgacatattgttatttgatggtggggaagttgaaaacatagatgtaaaaactggtttatacatatcggaggatttaggaaaaaagagaattgatgtagtacaaaaaaggtacggaagagtgttttcttcaaatattatggctgggatacatccggaggtgttaaatgaaagtactcaggggttaatcaaaaatactgcagtttacattttagactttaaaccaaaggggtctaaggatgctgacaagttttttaacgcctgtatggaggatgctaataaagagctactaagagataaggaatttaagccttctgtgtattttgtgagggcttataatcgtggggaaacggggtatttgagggcgaaattgtgcggtaagtacggtgagacagtgggacatatgaacgtagatcgtggagaggctaaaaaacagtctgctgcagagattagtactcgaaaccatatgttagcccagagtgtgtttaattatttaaatttggttatgacaccaagtttaacaataaactatgttgctgaaacggggaattttttatctggagaggttaaaaaagagtatattaaaaaacagagggaaacaattttccataaattgagggttcttcacttggttagtcattatggggaagatgatttagttcattttgatgatcaatggaataaggtttacagtcaggctgatgatatagggagacgtattaaacaaggtatgtcacgcactggagacttttcgcataatgatcatttatattatgtacagtctctagccggattatggagaaccaggcttaaaattaaaagtaaggattccgatatagtagatgatgagaggaagagggttgatcttcttttggcagtgttttcaggattaaatcaacaagcatcaatttattttattacggctataaaaattgcagaggattctggttgggggttacttgtgtaaccctctattgtttctttaattcattgacatttacataataatatagtatagtaaaattagtaaataaggagagatgatcgattgactatactgacagttattgtgggagcgggaggtacagggagttacgtcataaacaatttgcttaatttatatagagtgcggactaaagataggcatcgggtcatgctaattgacggagatgtcgttgaagagaaaaacctattacggcagggatttttacgtaaagacttaaataaagggaagtcagaggcactaataaatcggttcagaggtatggttggccataaggtgctactggcagcacatacgggttatgtgcagagtctgcaggatatagaccgaagcttggaggtattgatggatcttggggagaaagtggatccagatgatataagcgaggtcatattggttagttgtgtggataataaccttgcgaggttaaggctaacaatggcgcaattcaaggtatatcaggattttaactgcagggtttcgtttgtagactctggaaatgaagaatggtacggtcaggttcttgtatctgttttggatccggaatatccgaacccggttacttttaacgaaaatcgggttaagttcgacgagggaaaaatcaagggtcactggttaaataatatatttgtgttaatggatgactggaaaaataaattaaccaggggagaccatgaaataagttgcgatgtaataacggagagtagtcctcaaaatatcgcaacgaatatgaccgctgcaagcggagttctacttgtagttaaaaatatattagatagagaaccagtaccgaaaaacgtattttttaatactaaacagggggttaatcagattaaagataatttggttaaccaagaacaatatactaaacgacttaatgaactcgttgagtatgtaaatggggaaggaaaagtgtttatcttctcggtaggggaagagtatatggatgaggatctggtagatgaggaagattacgaggatgacttagattctcttgatgggctgtcttgggacgatttagaagaagatgaggatgatcttccggttgtgggatatattgaggatgatttagaagattggctggattttgaagaggatgaggctagtgtctccgaggtgcctaaaggtaggaataaccggtcattgtttaacgaagctcgggattggtaggaggttagtgctggttggagaagacggtgtatgtaaaaacaagaggtaaatttatattagttcctgttgattcgttgtatgttctagttgatgacaatgaaaacaaggaattggaggtaccaaaaaacctagtatcggttaagagaaactcagatggtactcgggagttaacatataggtttccgtatgtaaataaagtaatcaaagttaatccgggggttactttacacagaatattatttgctgggaggactacgggtgaccataggcaacttagaataactgattcgatggaaaactttctgagaaggtatataaaccaaacaggagggtttaggtacaaaagtcgatcaggtttggtaatgaagatggatgtttcaggcaacgataacaatttgcagcatagcagagagagtatcaagctgtttacctgcaatgaatcaagacctctgatgccgaatatttatcaagatagtcgtatgtgttgggggcggacagacaccgggggtaggttgcaaacgctagatgatttacatttgtattttcaccggtttatggattcaacagcaaatacggatttatctgtacggacttataacaagcaaaaagtattgagagcgttaaatggggttttaacaaatataaataattcatatttagatcaaagttataaagattctttaagtcaaataatctctttagagattgaagcggtcaataggcggaggcatattgaagttgaaacgtatacgtatttatggctcatgctatcggatatgttggatatcgatatagaagattttcgcaaacaattagtatctccgggaagggaatgatggtttatgggaaaagttcaaaaagaacccgttaaatatttgaaggaagcggtacggattgaagaggttagaaagcatttcgagcaaaaaattttagatgctgatcaaatcttatctctagagaagatagttagggataaaacgaccccggaggatgactattcgttatttattcaggggtttaggtcttctgaaattgcagagtttcgaagtgtaacaagacaagcagtgtccgcaaatataaaatctgaaagtcaaaaagtaaattcgcaagatcaagatgaatcaaaagaaaaacataaaaccaatcggaagaaattaattaaagctgccgaatggtactggggagtatatattacagatcaacgtggaacgttcgatcacattgaggatcttatatctgttcaggcttttgcaaacaaggctcggatggcgaaactgtattatgagttgggtgggaataagatggacttcgatttagatgagttggacggaaggatcagacgggggaaaaacaatcaaattaaaaatgaggcatttcgacttttagataagggaaagggttggaaagacttaaaagaggatttagggttaacggatagtcaggttatgtattatataagagcgtggaatgaaaaattggagaaagaaataaagagctgatattacgggagtctttttatagactcctttttgttatagtgattttaaatcggaaggagattgtggtgggataatggttaaagtttaaagagaagtgagggggaatatgtatgtccgaggagttaaatggggttattgaagtaggaaccaaatggtattatgaaacggggactggttgggtatggttaggtgtaatgttattaagtgggttaataatctgcctactatcatttagattcttatggctaaatgctaattatgaacccgggttgtcggtattttggagacgattttggggaataattttggcgagtggaatattgttaggatccggaggtttaggtatagggtacttggtagtgaaagatcaagataaaacgggagtattgtcaccaatatggactaagacaacaattcaagatgtagaatcagttgctaatagagggttctatcaaggagttaaaaataatcagggtctaagtggggagatacttgatcacgctgtaaaaaatgcaagcattgcgttttacgatcctaatggggatgactcttatgaagtgtatttaaaattaaatcaagtagttaagggttggagatcggaaaacgccgggaatattagtattcaagttgtagtggtggggaagaacgagtttaaaaaggattatggtaacttatatgatttaggtgatgggtctacatatcaagtggttcagaataaaaacttgttaaagatttttaatcgagttgatgtttatagtgaaatatcttttattgctggggttactggaggtgtgttgttagctttagcatttgttgcggcaattgtttgtaggcatgattggtacttatatacgattatagaggatgatgatttaacctatacggatgcaagttaattaagatggtggtatcgccatcttttttctttggataataaaagacttaggttaatttaggttttatagtaaacttatacaagaatataacagaagggaagagggatcgatgaagataaaaaagtgggggttaattgctgccactgtaattattttgctccctatgtttggtaacctggcaaacgctgcggagccgttagataagggtaaaaatgactggaagttttcaacgtatgaaaggtctacaaaaaccggaaaaactgtatataaaaataaaccgggttcaacgtataagatatggagtcactcagggggaaaagcgtatacgcgtaaagataaatctagatatttaccgggtcagtatgcaacacctctttataatgggaaggtacggaaactaaagacaaacaaatctagtgtttggttatatgaaccgaaaaataaaaagacgattaacattacaaaaaatacaccaatgaaaaaagtaaagaaaattaaccataaagtttcaatcaccattcggggcgagtcaaatggatggttttccacagatttaagtggaaatagaaagaagatggtgtatgtaaaggcatcggatatatccggggataagtactggtttttaaaaaagaaaacgaaaagtaagccaaaacctcaaaataacgacgcaaataaattaaaaacggtaggtaaaaataaacaattaattttggttactgcgaatagttatggtacaagtaaggcacaaattcaaacatttgaacgtgataaaaatgggtactgggttaaaaaactgtcggttagcgggtatatcggaaaatacgggttcgctaaaaaaatgtctgaaggtgggaaggcgagtccgagagggaagtatacgattgggactacttttggacgagttaaaaacccggggacaaaaatggcatatcggaaaataacaaataaagatgtttgggtagatgatgttaagtctaatctatataacacttggcaaaagaagccgactaaaaaccggtggaaatctgccgaggagatgaaccaaaaagcttatcagtatggatttgttattaattacaatacaaagagaacaaggggagcaggatccgcgatatttttccatgtatctaacatgtatactttgggttgtacggggacatcacaaaccaatgtagtgaaaattatgaaatggttagatcctaagaaaaacccagttataattcaaacgccaaagagtgagcttaaaaagtattaaataataatgatgatggcaatattgatggtaaacataaaaataatgataacttcgatggttttaattgataaaatagggggatgatcatatactataaaggcaaacaaacctttatgttgaccccaataaccttgtttataaatgcccatttaacagcagtcaaattcccccttgactgctgtttttatttttacttactttacttttatattattaaagtgtataataatattaataaaatttagttgtgggggatatttcatgagagatagtgtattaggaactaaaaatttaagttttaattggttagaggatcgaacaattttattagcacctactggaagttatgcgtatgggacaaacaccgaaaattcagataaggattataagggtgtttgtattccaccagaggagtactttttggggttaaaagcgtttaatgaatataacaatactggaggtaaaaactttaaaaatagtagagatgatgtcgatatatctattatgcatattaacaagtttgttaaggagtcagctaagggtaaccccacaagtttagagttgttgtttatggatgagaacagttatttaaaggtgacggacttggggaaaattttaattgataaccgacttttgtttttgtctaaaagagtaaagtctacgttcggcggttttgcgaaagctcagatgcaaaaattaataacgaaaaaagggaataacacagggagacaggaactcgtacagcaatatgggtatgatacgaagttctttatgcatagtgttcggatgctaacgagtgcaattgagattttggagacgggtaattatagaacgtatcgaccagatagagatatgctgttagactgccgaaatgggaagtatagttatgaggatgctatcgagattattaagcattatgattctaagttacaagaggcgtatctaaactctagtttacctgacgaggttgatcatgaaaaagttaataagatgctaattgatattaatagagaggctttgggtctgtactgaagtaagtgactttgggaatagggtcaggagaaaggggagtaactatgaacgatttaccgaaaagtggtgtaattgctgctgttgtgtgtttagtttttgctattgtttgtagtggatggttattgcataaaacccacaaaaaagatgaacaaataaaacaacaagcacatgaactaaaagaaaaagcgggaaaagaaaaagaagaagtgttgaagaaggggaaagaggtagacgctctggttatagacaagtcaaaaaacacgtattcgagcggggcttcggtttctgtgacgccggtggtagtgggtggcgctgtttacagcataccgacgacttccccgggtattgaaagcacaaattattatttaaagatatatgccgatgataaaaattacaatatttctgtaccgttaactttgtatgctgaaaagcaggtaggttcaagattaaagatcaaattgtataaggacaaaatagagattctataagaattgggttgtttggtagtggggagagtatttgtttaaattacataccggtaaagggtagagccgttaaaggctcttttttgtttgcatgaaagtataaaaaagggaaagagacttggtgtctgaaatgtaataactcaataagtaacaaccgagggtttggtttgtcaggtatacgtagattgggggaattatcaggcttctgggtttacggggcttgataaaatgtcaatgaaagggagacgattattgttgggtgctgcaattaaaaaaactatagcaactacgttaattgctacagcagcattgccgcttttatctggaggggtacatgcggcgggaaaaaataatgagggtgctgtagtagagaacaaagaggttgcgaacaaagatcattatgagtataacaacaaaatagatttattaggattttcaaataacattggtgatcataaagtatggagcaaaccttatggatctaagggagctaagtacgtaaagaatgcaaaagatttaaagggtgagcagttggaacttatcagagaagcaaaaaacgataagtcgacttggtatcagtttaaggtagacggaaaagtaattgggtgggtagacacccgggcagtaaatatacaacattatgaaaaactgaaggatcaaaaaaagtatgacaatgttggtgaagtaagggaagatagcaaagacttcgtttggaaatcaccgtatggaactaaacactcatacaaagttaaaccactatcggagctaaagggtgaaggtctgcagttagttaaaaaggcaaaaaccggggacagtatttggtatcagtttaagttaaatggtgagatatatggttgggttaaagaggactcacttaatgtcggaatgggaaaagttcggcacaaagtagttagtggggagactcttgagaagatcggcaaaaaatatgataagccatggaaaacgatatctgaattaaatcacttagcaaacccgaatgtgctgcatgttggacaaattcttttaattgctgagggagttcctgagcaaccagtatcagatagcggcgagtatagaagtgaaaatgaaggaaatccggtttataccgctccggcaaagtctacagatgatttaattggaaaaatatctggggcgactgttggaatgaagagtaagtataaaatccttccgagtgttgcgttagcacaagctattcttgaatctagaagtggtcagagtgggttggcggttaatgctaataacttgtttgggattaagggaacatataaagggcaatcggtagaaatgcctaccaaagagtttatcgatggtaaggaaacagaagtacctggtcagtttagaaaatatccatcttggaatgaatccttaattgattatgctgagttgttagcgtattcgcctagatacgctgcagtcgtaaatcaatttgattataaagcagctacaaaagcgctgcagagttctgggtatgcaacagatccaggatatgcaaacaagctaaatcatttgattgaaacttataatcttacacaatatgataaatgagtacagatatctagatcgttaagatctatgtaccaaatgatcattatatagtgttcatataaaaagagaccctattaagggtcttttatttttggataatatccggtgagaatacagaaaaattaaatggtacgatgaggttaatttaataacaaaggggttgtttaggtgaatattggtttagatattgatgggacattaacaaaattagatagggttttagaggtatttaatagggaatgtaaaaacgaattaactttagaagatattcaatattatgatttacataaatgttatggggtttcaaaagatattgagaaaaatgtgtgggttcaatatggggattatattgtaaagaatgcagtaccaattaaaaatttgagggttattgttgagaagttccgggatattagtaacaaaatcattcttataacatcaagacctaaaactcaaagagaaataacagaggcttggttaaaggaaaatggagttaaatatgatgagttagtgtttgctacgagagataaatgtttttatgtgccaaagtataatttaaatgtacttgtggatgacaacccagcagagttgatggcattaagaaatagtccattttggtctgtgtgtgaaggttggataattgatcaaccttataataaggggtgttatgcagataagagaattatgtttttcgatgatgggactttggttaatattttaggagcacaatcgggaagagttcggggttaaataagagtttttaatacggtcggtttccgacctttttatttttgataattattaaccgaatcactttttgtttttagattatactctttttagagaaaagactttttaagtcgatttttatacaaaaactgaatttaaaaaacaaaaccgatttttatacaacaaaaagagtttatttaaaataagggggagttttttgaacatcaatgattctgacaaaacaaaagaggattgtattaaagaactagctgatttttatggactaaaatatgatccaaacaaaacagagcttactataaaaaatgaatctggagaggttcgtgttttaaaggattcagaattgggtgaggttttgggtatacctcgggtaaataattgaagttgctaaaagtaagggtgtggaataggtggagtataactgcaatactcaatattataaaggattaccgatccgtttaattaacagggaggattatagacggaaaaatgcgaagcggtttgtaattaatgatacgaatcagaacgtatggattcccaaccgacacttacagggtgatggtacaattaaggaagatgaagatattgattatatctttgttaaagcaggacggcagctagagttagcggggtatcagttgtggtttaaaccaattggaggttaaatcaatggaacaatatcatggatatgtatgtgaaaagggatgcggtcataccacagtggttaataaatattataagcaaaaacaaatatattgtgctgtttgtggaagtaaggatcaaatggattatttgggtgagtatcaggtttcgaaaaaagaaccgactaaactgacttggggggaagattaatgtctgatgtaaaagatattttcaaacaaagcacgaaagaggctggcgagagattactaaagcttacaagtgattgggagaaggatttaagtaaggttagtaaagaagaaatggttgtattggtaaagtatgctgcacaggaaatggttcgaagatggaacatgtaccggggtcgttttgagcaaaaagactttggtcaaatgtgggaagttgcagatgttaaatcggagtattgtgaaagtgatgggttaacaagggagttttataaactaaaaaatggtgacgaggaaaagtgggtagatgtcaggacgtatctctctttacttgatttaggtttaattaaaacagggattaaggttaggggtatgttaggggcagaggttaaaaatggttgtgaaaaagaagtttaagataggtgatagggtctgggatgacaaaagaggatatggaacagtgtccacagaaacttaccatactagcaaccgcaatacttatacaggggttaaatacgatgattacctgggacaaaaatatcctctttgttgtgaaacagatgaacttatattagtaagggattaatggtgggggttaggacaattggggatgcatacggggttacgatttaagggtattgttaaaaaagagtttcgaggtctagttaaaaatttgatggtggatcgtttagaatggatggatatatacgaacactatcctcagtttgaatttttaagggtgtgggctgggtataaacgatcgtatcgaataccctttggtgatttagttaatatgccaattgagtgggcagaggacagtgttaaatttaaaccaaattttgaggaagatacggggttatggacgtttcagtgcagtttacggaatgatgttggtacgattgaaaagttttttgatgatatagtccctagactcgttgagaagtcaattcatattgagaggttctacgaggagtggagtcggagtcagctctatgaaattgtagacggaaaagttcatctatctggggatgatgggatatggtacgggatctaattgaagggtgcgaaaaagatttgttaagggtctacttaactacaatggaggatggttagagtgaacaagtatgctattggtatgtataacatggctgatggagatcataaagttaaaattgtggaggaagagacgagtattaaggctatctgtaaagctgtcggtgatgaagaattatggggcatcgtagatggtgaacttccttactctactgaagaagaagcttgtgttttttacttacagggagatttatcaatatctgagccggttctgattgggaagtctgggaatacagtatgattattgttataacagaagatgtaagggataaagaaaccggtttaacagagactatagtttcgtatgggtacgatacagaaacggggaaacctgtaattttgccacaggtaggtattgatggaatagacggggcggttttcaatagacaaatcggggagcatgtcatttattagggggatacatatagtggataataatttttcaagagtagagaaaacaatagcgaacggagtagagctaaatctaggcgggggcgcatccgctctggttgatttacatgtaagtgaggaagggtttttattaatcgacgggttaggtttagataagtttgattatgtgttcaactggcataaagatgataagggagataatagggtagagctgcagattctctttcctaatgagtagggtggttaagaaccctactttttttattattggggtttattttaggtgagttaagaggttagtgtaatataggggtgattattttgagtgaagagaaattcagtttagctgattatatttatcgtttaagaactgagagaaatttaaaacagaatgaacttgctaaacgtgcggggcttacaacatcttatatttcgcaaatagaaagcgggaaaaggacaaatccatcacctaagacaatggaaaagattgcacaggcgctttcaataccaactattgatgttataaaggtaatagactttatttccgatgaaaatccggtcaataatttaaggttatttgatgttagtggtttagaggatccggacattcagaggattgaagatcaaattgagttgttgaaaataaaaaataaatacaaagaaatgaaaaaaaggtagaggttgatgttactttgactgtgaacactggtgattaaaactaaaatgtggggggaaacgtatggttgatttcaaaaaatttagtgatccggaatggatagaagagtgggagaggaagaaaaaagaacgtgaaaagttgtatgaggaaaaagagaagttaaggaaacaaacagtatgtttcacggggcacagacctgacaaactcggtgggtacgatgaaaataaccctgtaatggttcggatgcggcaaaagttatttgaggttattgaaacattaattaatcaagaaggaaaaacaagatttataagtggaggagctttagggacagaccaagaagcgttttgggtagttgaggcattaaagaaagagtatcctaatatcgtcaacatcgtggcaacgccatttaaaaatcaagatagtgtatggtcagatactttaaagtataggtaccagcatatgttagagaaagctgatgaggttgttaatgttgaggagttagatgagtataaagttaaggggcagacgttaggtgagttttcaaaagaaaaaatgaagaaacgaaatgaatatatggtggatcatagtgaagcaatcgtggctgtattcgatgggtcacataaaagtggaactgcaaactgtattgcgtatgctcggaatcggtatttaggtcaccaattgtggaggttgtatccgcaagttgactttgatctagatataacgtacttagcgtaagggggtcatggttaaaaatgaaacaagatattgtaaggaagtatagggagtttagtgactacttaaatagcattgatttaagtcagttatgttcaatgtacagcagaaaagaattgcaagaattaaaggacacactacataaaatagacataagaagcctcccttatgagctgcgtacaaaaatagacgaaatgaagcatcgggagtatccacagctcttaggggtttatcgataccctgtaattaatgagattgattttttatcggatcaggagaaaacagatcttgataaacacttggggaggctccgggtgaatgatccggttttagggttatggagggcaatacgggtgcaagagatgcagacaaaagcattagattggttggcagatagaggagtacttactagggtttatgaggtactctgtccggattgtttgggggagcctgtatctagacgtttatctgcagacgaaaaacttaaattagagaaagaatttacggagtataaaaagtcggggactgataaggactatcacaagttacaaaaaatcattaatttaaactgtagagaatgcgaagaggaagaagatgaactgaattttttacatgttgaaaacttggagtttaaaatagagtataggttgaggatagaaagggacaaaagtttagattatgtatgatgggcaactatttgaccggtttgaggtaatatagtatgatgcaagtagcttatctgccaagtgtagaaggagccaggtggatttcgtaatgcgataaccaccctttattgcctacctgccatgtgtaggaaaggaatccggttttcgtaatgcgattaccggtttttaattgatatcttcgacttacttaaagtctgtcgactataaaggtttcaatcgctgaacccgtaatcagcgtaaggaaagtctgcgtatagcaggcttttttattttgtaggtatacctatagatgttttgggttctttgttactggatcagtattgataggagtcaccgaaaaaaccacagaaatattatgtatactgattgtattcatgaatcggattttagattttattgaaaatgatcataggtgaaaattgagaaggttattcttgaatgttgtgtagggagtgaattagtttgtcagaagtaattgagaaaattgagattagtgaagtactgggagaaaaatttggaacatattctaagtatattattcaagatcgggcattgccggatgttagggacggattaaagcccgttcagagacgtattctatacatgatgcatttaaggggaaatacacaggataaaccatataggaagtcggcagcagctgtaggggatgttatgggtaagctacacccgcatggtgatagttcaatttatgaggcaatgtctagaatgagtcaggaatggaagatgggaatgactctagtagattttcatggaaataacggatcaattgatggggattccccggcagctatgaggtatacggatacaaggctacagaaaattgcttcggaaggttttatgtctggtatcaataaagacggaattgtaccaatgattaataactatgacgatacaatgaaagagcctgtggttttaccggcaagtttcccaaatcttttggttaacggtgtatgggggattagttcaggttatgggacagatatcgcccctcataactttacggaggtattaaagggttgcatacttcttattaacaatccagatacgacattggatgaattgcttgaagttattcccgctccggatttccctactggaggggttgttgtgggcgccaaacatttgcgggacgtatatgcgacaggtaaggggaaaatcgttgtaaggtctaaatatcatattgaaaaggacaaaaagagaaagtatatcattattgatgagatcccttatgatttaaataaaacaacgttggttaaagatctgcagaaggttgcggatagtaaaaaggttgaggggtttattgatgctagagacgagtcagatcggaaagggttaagagtagctattgagttacacaaagatgctgatgaaaacattgttttggggtatttattcaaaaatacgcagctacagaaaaactataatctaaacatggttgcggttaaggataaaaaaccaaagttattaggtttacgtgaaatccttgtagcgtttaatgatttccggatagaaactagaactaaagaattgaggtatgacaaaaagaaaaccgaaaagagattacatatcgttgaagggttcattaagttggttgatattctcgatgaagtaattgcggtaattaaagagtctgatggtaagtctggggctaagaaagatattatcgatgaatttgggttttcagatgaacaagctgaggagatcgttaaactccaattatatagaatatctaaaactgacaagaaaaaatatgatgatgaaaaagagctgctgacaaaaaaattaaatcaaataatcaaacttttagaatcgccagcaaaattgagaaggaatattgcaaaggggtatgagaagttaattgagaattttggtgttgagagaagaacagaagtagttcaggaaaatgaatcatgggatgtaactaagaaggatattgtaaaagaagaagatgtttatgttggggtctcaaagggtggatacattaaacgttctagttcaagaagctatagttccgcaacagcctgtgggttagttgagggtgacgaactgttatttgaacaaaagaccaatacaaaacacagtttgctattgttcaccaataaaatgaattatatgtacattccagttcatgagattgaagaagcaaaatggggtgacactggtaaacatatagcaagctatggagttgatctaggtcaggatgaaaaaatcgtcactgtgtttacggttagtgacgaggataggaataaatatattttaattgcaaaaacaaacggtcaggttaaacggacagcggtctctgagtatgaggttgttcggaagttctttaatctatatatggctgctaaacaaaaggacaatgaagaattagctggggcttggttagtcggcgatatcgggtatatagcttttgaggataaagatagtaagagaatgtatttcgcaataaatgaagttgcaccaacaggattaaaaacaaagggtatgaggggtatacatttagaagatgagagtcggggtataaatcaagttatcttctgtccgacagaggaagatataccggacgggtacaaatatagggaaagagggaagaaaggttgggcgtaatgcctagccttttttctttgtctaaatacatagggatagttaacagtattggatgctgaataaacaataaaaagacaatccatattcggcttaaatatataaacaaaatctaggggtgttagtgtgagaaagtattttaccgaggtgtaccgggtgataaatgaaaaaaccgttgaacttacatttgtaatgaagagtaatccgcaaatcataccgcttagggaagttcacttacagcaagcaaaaaaagtagcagcgggcggagggtctgatctcttaaagctttacgaggattatgaagtagtcaatccagacaaattggagaggtattctccatacacagtaatgtatgaccatcaggcaattatgggattggtgttgttaaatgagggggatcgtctagcaagggttatcgtggaaaattcaattgatggtgacgagattacaacagatatcaacctaactttaatcggtatttgggatggttttgcagtacaggtacacgagacactgtcagctaaggacgacgaacggttaaaaaggattttaaatgagagagctatggatttaaccgggctactggaaaatgtattcaaagccggaatctttattaagtaatgcaataagaagattatcttgtgtgggaggtttggggggatatgccggatagcaagtttttcagaaagtagataagtactgaaattgtggaataaaaatagtgttataagagaagatatctgctggggcaggttattatttgggaggtttatatgaaacagggagcaaaaattacagcatcggttgcattagcggtagtcactattgcagcgataccagtttatgattttttcatcaaagataggttaggtacagaacaagttttagtagttaaggaagggcaaactgttcagaaatcagatgtgctggacaataataatttagtcattcaaagaagaccgaaggatcaaattccggacggagctattacagctgatcaagctgacaaaattgcgggtaaaaaggcaagtgcagttatttcaggtaactccgtactgtctaaggacattgtagactttgacgatctggttcctgataagaagaaggatgaggcaatccgacctttaacagaggatatgttgtttgctaaaccaggatctttacggagaaacgatacggtaaatatctacgctcttacagagacacagtggggtaaggttcatcacgaggaggacaatacttccggagatgggtcaaaaactgctaaatccacaagtttaacggatgcagacattcaaaatagtaatgatcctattttaaagggagttaaagtagcgtatgtaaaggacagcagcaataaagaggttcaaagctctacagaagatggtggggaagctgcggctagtaaacaaaaacaatctaatagtgatcgtttaaatgctacaagcaccatttctgaattggaggtcatcttgagtgaaaaagatttccaaaaattaatgacacaaacagttggcgaaggcaaaaagctttatattacgtaccagtaagagtaagggggaagttgttttgaactttgttttagttagtcgggatgaagagttaaaaggtgtattaaaaagaggtattccggagtatccagatgtgtatgtatttgattctattgatgatgcatccttagcggttaaggacgtagctgtggtgctccttgatggtaagtgtgtagtggcagatgattttgagaaggttagacaggggtatccggaaacagaaatcatttacacaatgcacaacattaaggcgaatgttatatctaaacatttgcaaatgttagctatggcgcactcagtagatcttataggggagcatagaacagcggatcagattgtaaagcaggtaagaaaaattttatttaaagaatctgatgcttcttctagacgaattgtttctttctttggaactcattcgggtgcgggggtaagtacaactaccttaaatatctcaaaattgttggggaataaaattgcgggcgatgtactattgattactctaaatccatgggattccggagattatcattataattacaaaaagaagaatctaaatgatcttaaagtcgatcttaggggaaaatcgttaaatccggagagattaaaggatgcttgcaactattacgataaaactttttatcatctagcgggtaataaagatattaagctgcagaggtactttacgaacgaggagattgattatttattgcatgtagcactaaaaacatttgagttagttattgttgacggtggggcacattttgataccgctgcaacaacacaagcgtatattcaaggtggttcaaggttcttgatcactacacaggagcaaaaagggtatcgtgggaacttcccgcttgtttttgatcagttaattaaacctaccgggggaacatcagaagatttcggacttattgttaatcagtatgagccggatagcaatctacctagtgattctgatatctcttctgagttaggtatggcgaaaattgttacaatccccgatgtaggaaagttaagtaaaatcgcttcttatcaggaaaaaatgctcgtggacatggggaaatccatttatttagagccgctaactactcttgcaaactacattattaaagcatccggggtgaaggaggatgtgagtgaaaaaagcgagaagaagagttctaaaaaaagttgggcgttatgggggtaaaaaggtatgggtttaggtaccaaaacggtttctagtttagaggaagtgttgggtttaggggatccatttagttcaaagagttttattgatgaggtaaatgagtccaaaaaacttcaggatgatggtgtagggggtgaggtatttgaatctcatcccgaatttaaaaggatatgtgcaattgttgaggagaaaatgcgtgaaaaagctggagagtctgtagatgacggtggcagtaaagaatttttagagcgtcaacataaagcggttattggggatccaaaagcaattgattcttttatgcaagagatacagaaaatacttggggacaataacttgagtactaaatcgtttccagatatttttgaagatcttccgacagcggtatttcatatgatttggggagtggggatcttacataagtgggataagatgccgaattcggaggctgcagttattcgtggaactcagttatggatagatgtaaatgggcggatggaattgcaggaagagtcatttgaaacgttagaagaggttgagagggtaaggaaggtgtttttgcttaaaaaagcggattccgtcatcaacagtcaaaaccctgaattagaggtagaacgtgaagacggtacccggattacaatgactcagagtccaaggtcattggaacattacattgtatttagaagatttgttgttaaagaaacaagtcttaaaaagcaagccgaattaggaacaatacctatgagagatgtacctctttatgaggcgttttcaagggtgatggctaacatcatttttgctggtcgtgtacgatctgcaaaatctacatttttaaaggctatgattggtgccagaccggatgatcacataattgctgttctagagaaacaccatgagttggctttgtctaaagcatttccatccagattaatttatgaggttcaagcaaaagagggagacttacacaaagcagtacctaccttattgcgtatggaacatgattctcttgttgttggggagatcaggtcattagagacagaggcttatttagaagcaacagagcgtggggagcggggagcattttcaacctatcacttaacggatgttgaaaatgtaacacagcagattacccgacacttattagatgagtttcctaacagggattttgacaatgagcatgctagggtggcacagaacatcgatcttatatttattcatacatcagaaagggatcgacgctctaaacggttagttagggtaacggaaattgtttgggatgaaggcaataaaagggtaataactcaggacttaattcgttggtcaccaattaaaaagaaatactattattcgtcaagtatatctaaacggttgctgcttctaatgttagagcaaaacgaagaagaaacaaggaagttagtaaggattctaagcgaacgtgaaagggaatctccgttatctgaatataaagatgaagagtacaaaatagttgaagatttgctaggagaggtgagagatgctgaatttattgaatcttgaagatctagggatatggcttaaaaattcaggtgtggattattttctttacaccctccttttcttggcagtccttttcattacaatttcggttgttcaagagcctattaaaattaaatatcgggattggaactatcgagttaagaggacacaacaaactcatgtagaaaaggcattggagacattagaggaagaaagtattgttcagaatatatctctaatgctaaaggctacagcaaaaaaagggaaagatccacaaacattgagtacctttttcattatatcttttctttgttttttgtttgtgtttgtcataatgtttgttgctgtaaaaatggttattgtttctttagcaatagggttactagctggatgcattccgtatgcagttctagttgcaaaacttaacagtattcgtattgctgtagggaatgagtttttacggtttattcaggtattctcacaacaatataacgctaacgggtatgacattcagtttgctttaaggtccacattaaatgagatgcaagataaggatatgaagaaagcattaacccagttgattagtgatttgaatactaatagggatgaatccggtgtacgtaaagccgtacaggagtttgtatatattaatgggtctaactggtcaaaacggttaggtaacattctagtcaagggttatctagagcaacaaaacgttttaaaacccttactgttccttgtaaaacaggtagaaaaaactgaggaaatgatagcggcagaaaagtcagaagtgatgtcggttgctattgaagggtatatgcagccggttatactgattggttcattgggtttgggtgtatatacatgtaaaatgcagggttggtggcagttacaatttggtgagcatacccctttgatgttactggcttttgggattgtaggagtaattttttcagtagttgtaggtcttcttgttcaaaacattaaaaacgatgtataggaggtgatcaggtgttaatgttgcttacggtttttgtacatctaatcgctgtttcaggggctatagggtctggaattttgttttactccggaatatcgactcaggaggagttaatgctgggtaagttcagaatccagcatgaatttgttaagcgggttagaagacttaaagatgagaacgaggagtccaagcttgaaaagattttaaaagatgctggttatccatttgggttgaatgctaatagatacaccgcgatttttattggtttgatgttggtaatcctagtcgcttatgttgttaccccagcgtttaggggtgacggttttaatctgtttggtttggtgtctgtcgtcgcagtatttcttattggtacaccagatataaaatatagtgggtttaacttcttgatgaaaaaagtaaaggaattaaaccaagcgaaaatacaagcagaagtttttacattttatgagttggcattaaatgaacttcgattaatggaaaactctagaattcaggcgtatacaatgataagggatctggcaccgaacttttcaaaaatggcaccttctataaacatgctcttatttaactggaatacggtcggtcatgcatctgctttagatgcgtgggctaaagaagttggcggtgaagaagctagagcgttggccagtgtattcaaaacattagacgtagttgacagggatacagcaatcaaaagtcttgagggtcaacaagagatgtttatgaaggctcaaattgaaaactttagacgacgtattaaggtgaaggcggatttagccaaactgcctatcatggctacgtttgctttgcttatggctaactatctggctgttgtagtgattatgtgcctaaacctgttaaattccaatatgtaggaggtgggtaggcgtatgagtaaaacagtacagatattgttgggggtttcagctacggtcggggtgattgttcttgttatttatggaaccatgggagatagtttatctgggtttgccgatcgtatggcagaatttttaaatatgagttaaataggggtgttaaggtgagaaagagtgttgcagttctgttaatggttgggtttactgcggtattctttgggtctatgtatcttgggttagtagttaatggtgcggcagcagataaaaatgaccggtatcatgacacattcaataacgatcatcaggtggaaccaataaataagtagattgagtgatagtaaaagtagactgaaagtaattaagtatttagggaataaagtataaaaattaagaggtatggactttaaacaagttcgtatcaaattgaagggatgagtataggtaatgaaaaaaacagttctaacgtttcttggggtagcagttggggtagcagtgtttgcgtcattggttgtcggattgttgcaacctaacattgagtcaaacgctaatagcacaaacacaaaaattacaaaaacatttgaaacaattaaataaacggttacgggtcgaggttaatacctcggctttttttatgtggacatcagtatagatagaaagggaaatttatttgaaagaggtaaatgtaagggacggcaaaaggttatttaggagggtaaagaatgagtgaagcggtaggtaagtggttaactgtatttttcgcaatgattataatatctacgcctattatgttttatattgatgattcccataaagaggcggttagcattgtgttgaatgagggagcaaagagagcatctattgacggagggtatacacagagcacgattaatgatatgaaatcccagttagaggacaaatataaaattggtagaggaaacgttagcatttcagcggatactgggtctaaaaagttcatgaggggtgagtatattacagcgtctattaccatcccgagatccccaattttccttgtcgatatttttgctaaggggaaagcggtgtctagttatacaaagactataaaagtgatgtctgaatatcaagaaccaccaacattaaacgattaggtggaggttaagtaaatgggagatacaatacgaactatatttttaattgctgcattttcaattcttatggcgttccagattaatatggctgcggatatacgaacaacacaccaattgaagaatggagcagagatagcgatacatgatgctatgttagcgtataacaaagaggagttatctaagggaaaagttgtttttaatcagacgtatgcaaaaaagtacttggtggatagtttaaatgccaatttgaagttaacaggaactgctacgtctactacactttatcctaaaaaggattcattttttacgcagccagttaaaatattaaaagttgtgtttgtggatgaatcaaatactagatcttttccttatacatataaggatccagaatatgatgtaacgcaaatattaaaacgaccaggtatagtggcaattttagaaacaaaggcaccaaggtactttaaaggcgaagatacaattgtgaggcaagcaacatcctttgagtttcaacagagttgggttgagaactaaggttttgatagaaatagaggtttagatagaaacaaaatgaacgtagggggaaagttatggtgggtaagggagagaaaaagaagaaatctaggtggttagttttaagtggagcggctgcactaatattgatcgcagcgggttgttgggtgttttttgcaaagtattatgtaccattaaatgtttggaaggaaaggggtgagatttatgagctacgaaaaaacttagaggtgttgaataaaaaagaggatgggtttgtaagaaaagaagatgattacatcgccaaaactccggatagtacaggggagtttgtggatatggaaaagaaggtaactaatctatttccaatgtctattaatgctccaaaggattatccaactgcttataaggatgcggttaagtgggctaaagatctggctgcagggaaagtgagaaaagatgatacaataaatcattttcttacaaaaacctatgtagaagataaccagaaatataatgtagggcagccgatcgttgcggttaaggaactggatacgttttatataccagacgcctattgggggttatatgatgtagcagctaaagaaggtgcgtatcaggaatctgttcaggtaacagctttttggtacaacaaggatacaggtaagacgacggggtgtacatagggttcaaacctaacccgggtgcttatcagaatgtaaaggaggagtagtgttgaaaggaacattgaaaaggaatagtttagtctctctctccttagttgtagtattaagtacggcagtgtcagctttttcaccagtaggggttaaaacagcgagtgcagcacaaacagtatccaaaacagtgacgtataaagggttaagcagtaaggatcagagtaaaatttccccacagacgataaattacaacgagaatggacacacgggaacattaaaaataactaatgtggagtggacaccggagtataaaacaaatcgaaccacgggaacattaactaaatctgaaacggtcaataagtatttggatcgtgagggaactccaagttttgcaaatacggtgagttatacgtataccgataaagaggacggaaacaaaaaacatacgtttactctaaataaatccggaagtccagttaaaacgagtaccacaactggggatgaaatcgtagatactcagggcgggtacatggctatgctgcaggatgcaaaagccaacaaggtaaagttccacagccggttaggttggttgtcgaatacgaaccaaaagtattttgggtcgaatacaggggacacctttgttagcggtaagtattattttaaggattctttacccagcccgggtgcgggaacgaaatggaagaatttaaagccgggaacaacctttggcgaggcttggggaagagaaaaagaaaaatggacggttacaaaataccgatggggagatagtagaccttattccgctcgggaagtgtacacttctttagggaaaaactataatgtcagccggcttaaatggaatggaaaagacggggacatgtattattcaagttcatttggtgactacatctggttagcttggacagataatccgaaagatgcgttaacgagacacaatgaataccgtaagggagcagatgtaacttacaaatttaccggggttaaatataataactggaggcaggattataaggggaacctcaagcttcctgatataattacgggttatactgccaaggttacttacagcggaaaggttattgctccgccaaaggcagggtttaacccaagcaagaacccagctacaagacttgataaggtaacgtttacctccacagcgactgatcctgacggagaaaagttaagttatacttggaacattagaaaaaagggaagttctagttggggttctatgattgggtctacttccgccacttatgattttacaaaagagggaaaggcggcattgggtgattgggaagttaaacaaacagttaagaatgaaagtggcttaactgatagtgtaaccaaggttataacagttaaagctttaaaacctacagctgggtttaatatttcaccaagtacgaccaatcgtttaaataaatatgcgattacatcaacagcaacgaatccatatgcgtctgaacttacgtataagtatgaaattaggttaacagatcctagttccggattcgcagctaattcatggaagagtttatcatcaaataaatctttttccgctcaaattaaagagttgtatgggacaaacccgtcgaatacttatcaagttcgacaaactgtaactaatgaggatggggaatccgatactgcactaaagacgttaaaaatagaagatcttgcacctgttggcgggtttaaaatctccaatgtaaatacgtatattaacgatacggtgagtgtgacgtctactgcatcggatccggagaaagatgccattacgtacttgtacaaggtgacaagcccttccggtaaagtaagtgagtataaaacagcaaacttctcgtataaagttactgagcctggggagtataagatttctcaagtcgttactgacgtatatggcttaaaggggtcggcggaatccgcagcgaatggggtagacttatcaattaaaggtaaggttagccatacaaaagattgggaagagaagcatgctgaaagagtgaaaaatggtattgaaaaagaggggattttctacagtggagagcagtttatcttagaggcaacgaccactactgcagaggtatcctcagtttatgcggagttaaatacaattaacgatagcggtaaaccggttaaagttaaagtaaaaatggtgcaaaacgaaacagataagaaaaaatgggaagcggtaatggagcctagagatgaatggttagttgaaaaaaccagactagctaaggggcagacaccatttacattcactgcaacctataaaaacggtacggttaggagtacagtggttaatatagaaattgatcgaattgttacaacgattttagatgtgcacaagaagtttggaatataatgatgataatcagagagggctgaggctctctcttttttggtatactacagaagaagaaggaggaggtctggtgcagcactattgggttggcttttgtttattaaataaaaataggataatgatagatgtctgtttagagactgaaactggtgcagactttaaatttattttacctacatccggtggagatacaccttctaccccttgggttgatatagatgactacataaaagaaaaatatcaggtctttccgaggtttgtttttgatgaaaagtttaggtttgatgaaaatagtaacaaggagctttatgcgtcttcttatatgatggaacccgggacagttttcaggttagtttcggttaatgataaatctaaggcaagagtggctagaatcttacttgagcgaaaatgggtaggtcaaggacagtttcagttggggtataccgtaatgaattacaaaaagattacgggagatgaagctgacgaaaacgagtttgagaatttaaacgaggctctgaagaaaaacaaaaataaactgatgaccgaagttaataagcaatgtagcattctggagaaaactttacttgagtttgaaaaataaaatcttgatagtaagcaacaaatgttaacaatgtatttttgttaggataaatatagatttaaaatttaattattttttagggtttaagggaggaagttaggtatggcaaaaacaagtttagtagaggttattgggttaaaaaagaatacagggattgatccaatcgcgacgttttcaactaaggggttagcaaattggcacatcaataacacgtttggtgatcgtggattcgataagctgttaactcggaatgtttctaaaaagggagaaaactttattccggatacgttggcggaggataaaaaccaatatgtacatgttaaagcaggaatgaaatcgtatgactgggatacgttaaatatcagtgtagtaaaggggacattattagggttctatttagacggtttagttaagtcggaaaaaacgattggtaaacttgggacagcagatttcgagggagatgaggcgcaagttagcgtagtattggggatgaatgatcctattccttataataagctatctagtgcgttagaaaaggtaattgttgaatcgattgttggtgacactgaggcagcggcagcagtcgaagatgaagagtctgaggatgtagtagaagaacaatctacaccagacgaagataatattgataatgatgacgatgatgaagctgatgaggatgatgaaagcgagttagaggttgttgagtatgaggatgatgacgaagtcgacgaagaggatgaggtcgttgatgaggatgattccgaattatcagatgatgaagaggctgatttagaagaggatcttgatggggatatcgatgattctgaagaggatgatgactccgaagatgaggaggaagatgacgaggaggaagagtctgaattagaagaggatgaggacgaggaagaatccgatttggaagaggacgacgaagaggaagaagatgaagaagagttcgatttagaagaagaggatgaagaagagttcgatttagaagaagaggatgaagaagaaggtgacgaggatctagaattcgatgaagaggaagaagatgaggacgatgaagagagtatcgaagatttagatgctgagttagaaaatttagatgtggattaatagaagcgggaatctcccgcttttttcatataagaatgtttaggggaactctgagtggggttccctttttaaattttctggatacatataatcaattagaaagatgatcaatttgttacagtaaaaatagaggggaggggttgagcgatgaaaaaagtaaaaagtttttttaaaaagggttgggtacagtggtcgataatgtcggtcattattttgtgtggattggtcattggtattttaaatattgttcatcaagatcaagaaattaagaataatgatactcaaaatgtcttggggaaataatgacttctctgaaattaaaaagccaagtatagaatcattatcaaaaaacacgaaggggttaggtaaatagatgatttcggcatcagaggataaacttctttatgatcattctgaaactatggatattgcatttggtgaatggtataggagaaataaaaacagtaacgcagtaatcacaccaactagtataagatctgatccaagattagaaaagctgattaaagttatcttagcagaagctattgaggttgaggctacggatatacaaataaccaaccgtgaatcatacggactagttaggtttcgggttggtacgaaaatggtggatcataggaagattcataaggatgccatgtacggtttaggggtagttcttaggtcaatgtctgatgtaaatattgaggagattaataaggcgcaaattaatggacggtttgcgtatgatcacggtaggagtaggtatgacgttagggctgcttttataccaagtatcggagggcagacaatatcgctcagggttctttattctaaccgtctgggcgggaatattgataagctggggtttcctgaccaggttagtaaaacgctaaaggaagttttaagtttaaaggagggacttatttttcttacgggaggaacaagttccggtaaaacaactactttgtacacgtcaattaggcatataatcaacaaaacaggtgctactaaaaatataatgactatcgaaaatccgatcgagtatcaaatagatggggttgagcagtcgcaaacaaatgacattttaggttatgattttgcaacggcattacaggctttgttgaggatggatccagatgtgatacttgtcggtgaggtcaatgatgaggggactgcaagggctgcagtacgtgcggcgtcctcggggcatttggtattatccacattacacactagtgatacggtgtccgttaatcaggttttgaggtactatggcatttctcgattggatatgggtaactcactgcagttggtaattaaccaaacgttagaggagaaactgtgtccacattgcaggaaaccgagggcggttacatcatcagaattaaattggatgaccaaacggttaaagactaacgagcaaatagttacggtttatgagaaaaatccagtaggttgttctgagtgtcaggggtacgggatcaaggggttagtacttgtggttgaaatgctagatgctaatcatgtatataaaaaggctttagatgattcacaagaggatctagacaagttaaaagagatgttaatgaccagggagtttgcaaatttttatccaaaagagtgggatgtctttaggcatttacagaaggggaatatagatatggctacagccaagaaaattttacgttaggggtgggttaatgttttttaaaattatgtttatgtatgggttttggtttacttgggtgatttttttagctgcatacgttttatttatgtacggtcttatggaaaaaagaagcttaaagggtgctggagcagcgttcgattcaagttttaaacgtttgtatagtgtctctattattcagttgatgattgcagttgtgttggtgtttagtccaattattctggggtttattcatgttcattggtattggatatgcaccggcatgattacaacattgtttattggtggaaccatgtatctgtttatgaggtatgctgaaaacctatcagataaggattcagcggagtttaagcccaaaaaacaaattggttcagatcaagcaattgagaagctctacaaacacaaaaaggtattctgggtatatgtagcggtggtgttgtttgtttatatttgtatcccgttagatgcgttcaatgtcattaaaataacaaattcaataatgcccaatatggcaccattgtatgtatttatgttgtcggatgtaataaaagtattgtgtatggttattgctaatgggttgctcataatttcggttaggaaatatttgacggcgtactttatagctatggggtcaacacaaaaatagaagcaatgatagagttagatattcgaaatggggatattgtaggaaacctggggaagaggtaactgattgtattgagctgaaataggtcaaataacatacgggtttagtattatagtatagggtttagggggacttaacgtgattgtgtacgacagtaggacaggaacaactaagagtactgcattgagagtaggtaatgcattagggttgaaagttaaggatgtaagggattttgaaaaggaagaagttacagaaccatttgtattctttacatatacgatgggtaagggagagacaccgaggagatcggtttggtttttaaataagtggggtcataaaatgatggctgtagtcgccaatgggtcaaataggtttattccagtaggattatttgcaactgccggggaaaccattgcaaatcagtatcaagttgaattaataaccaagttggatatgggcggaaccatagaggatatgagcaagttggtaaagagaatcggtgagcttcatgggttacaggtcggtaccggtcaggcagcgattaaaacaggatcacagtttaaaaacgggcatttcaagttgaagatgttagttagtgaataagggggttcaagaatgtctgtaaaaagtgcagtagagaaatggaatagtgattatttgcgatataacgttttagcgagtgaaaaggatgagatgggaaggtatcaaaccgaacatgatctcacggcgttaaaaatgatcatagaggaagcaaagcaggctacaatgcgatttgaaagtaaaaaacagcgtatggagtttatgattcgcaacgggttttataaagaggatttgttacgaggagatatcacttattcagatattgaagggttgtataatacgtataaaaagcacgatagaggggatattgcttttatttctcaactggtgtttctcagctcaaattatgcgtataagttattagaaagtgaagtggaaggtttagttgaggactggcagttaccaccgaaacgatatgatgacaaatacattctaatggaagataagtcagatcgagctgtagctatagctctagaggtgtcaggaggaaaattagatctggcacacgatgtagttaaaggaatggctatgaggtcttatcatccagcaacaccaacctatgcaaatgcgggggttaaaggtgacggtcagctaacaagttgttttattttaaagtttaaagatagcttacagtcagtagcggatatggattcatatactatccatttaagcgatatgggtggaggtattggatttgatgcaactgatgttaaagctgttggggaaaaggttggaaatatagataacaggtctattggcgtactccctcttgctaacagagctgaacaggctttatctatagctgtgcagggtggaatccgaaagggtaatggtgtatttttcttagatgttttccacccagatatttatgccttgcttgatgcaaaaaaggaaaacacagatgaaaaaacgagattaagttttctttcagtaggcgtaattatgagagataaattcatggaactttttgaacagggtaaagattattatgttttttatccgaattcggtgtatgaggaatatggtattcgtttatccgatatcgatatgaataaaatgtatgatgaactggttgcgaatccgagggtgcggaaagagagatacaataccggagactttatgaatttgtgtgctagggtggcgagtgaaagcggatatccgtatttcatgttcagggagactgtaaatgagagtcatgtgtttaagggtgcaatggtctattcatcaaatctttgtactgaagtgttacaaagacaagatgatggcaatggggttcaatgtacattagcttccgttaatatcttagagacaatgaaaaataaaaacattgctgagacagtaaggttagtgactcgacatttaaatggagtattagatcgtggagatatgtcaattgtaccggatattgaaaaagcgagattgcggtttagagccattggtatgggagctatgaatcttcatgggtactttgcaaatgtaggcattccatatgagagtgaatacgctattgattttgtaagaacatattttatgatgatgaactactattccatttctacgagtgttgatttggttgatgaatacggcgtgtttgatgagtttaaagatacaacttacgcagatggtacgtactttgataaatacctaaaaacagattacagaccggttacagatagggtcaaaaatctattcaagggtgtttatattcctaccccagaggattggaaaaccctgaaatatgtggtacagaaaaggggtatggcgaacgcctatcgtatttgtattgctccaacagggaaaatcagttatttatctggggcaacacaaagtgttatgccaattacacaacttgtagaaagtagtgtaactaaagattacaaagcatttttcccgatgccggggttaagtcaaagtaattattttctatataaaaatgcgtaccgaattgatgactttaagatgttaaaccttattgcaacaattcaggagcatgtggatcaaggaattagtactacattgtttattacaagtgagtatacgtcatctatttgggctgagagagttctgtatgcgtggaagttagggcttaaaacattgtattatgcaagacctaaaaagacagtacacagtgggtttagtggcaatggagacgatggtattgaggttagtaactatgaggagtgtgagtcctgcacttgatgcggggcttcaaagttgagggggaattagggtgaaaagaagatcaccggttaaggcgattagatggaatcattgtaaggatccagttattgtggaagcacacaaattgaatcaagctaatacttggacaacgggtcgaattagtgtcatcgaggataaagtatcctggacaaaaatgagcgatactgaaaaaagagcttacgttttaacattcttagtgctatctaggattgatgctgaacagggtcttgtaggtatgaatgcggtagcgtataacagcccggataactataccaaggcgacatttacatatcaatcaggtatagagatgatccattcacaggtatatcaccgggctttgacagaatttatacagttgtcggaggagttaaagttcacgaactgggctgatgattctagagaagtgaacgatgtaatcgagtatttaattaataatattgttgatgttgaaaatgatccagatgagttggttagttacttgttgcagcttgcttactcaacggtattggagaattatgtgttttatttattgttttataatccgttgtacgaagcgtcggttaagtaccgtatgactaagtgtgcagaggcagtaaggttaattatgcgggacgagtcagtgcacggatcattctccgggtacatcttcaaaaaatactggaaagaggcaacagaaatccaaaaagaaaaggttaattctaggtttgagaaatttttagatacactatatggacgtgtagaagccctcttaaattttatatatacagatccttttattattgaagatattaaaagatttgctaatttcaatttaaacagaacgttagtgaatcttggatttagtgaagtcttttctggggatgatattgtttttcatcctgcagttgaagccgaagttaagtatgatatggaatctactcacgatattttttcaatggctggggattcttattttatgatggactcaacggcttgggttaaggataatgttgaaaatgtgcagagaaaattaaaagagaagccagatttagttccggtactcagagggtgaagtgttgggtgggggtgataatacctccaccgtttttaatttgaagatgtgttaaatttagtatacatcaaggttatggagggttaatgtatggtcgaagtaatggataagaaaaaagaaattgtgttagccgtaagatctgatttattgtttgatgagggttctcggtttcaaggatttattagtaaggtaaggggacaacacttagtaaataatcttgctctagctgaggcaattactaggggagatgcggactatgatgaaacaggagattttagtggatataagcagctgatttcatatggagtagtaagggctaaagatacaggtagggtgtttgcatacaaacgacttgaaaaaagcggagaagagaaactcagagggttgggtagtgttggtattggtgggcatatgaatccggttaaggatgctacaaccattgaagaagtgttaaggttgaatacgtatagagaagttcaagaggagttaaatatctcagaaccgttggatgacgtcaaaatgattggttttattaatgatgatagtaatgatgtggggaagcgccatattggaattgtatatgaagttgtagtgagtagcgagaatacggttagcgtgaacgaaacagaaaatctagaggggtactggctaaccaatgatgagtttaaaaagattgacagtaatacatatgagaattggacagtgttactgagtaagggtttagtttagagacagtataaggggcgagagcctcttattttttatggaaagatatatttaaaggaaactccataaggtatacattacaaagctaaggtatggtggtgtaattgttcacgtatatactgtggggtttaataataggagttttaatacttgcagctaggggtttaggaagagctgcggttggtggggttgtatttattggggcactatttttcgccattttcatgttggatacctttacaacactggatataagacgttatgtaccaattatgttttatgaccaaacagtgaaggatccgcaaggtacagcagccgaggtaaaaaataaagtgttagctggaggacgggaagcggctaatgaggttaacgatgcggggaagagagcggatgagacttatggtcttaatgaagataaagaatggcacaataatgaggatgaagataaaaagaaaaaaacagaagaaaagactcggggaaaagtaagtaagaaatttattaggtatgacgatgctgagaatgatatcactaagtacttctctgacttatctgccaaggataaggatatttcgttgtcaatgtcgcctatttacaaaataaaaattaggggtgaccaggtgactgtatggaatacaggggacagcggtgagaacggtttttatattgagagaaattagggggtaacatttgtggaattgtttagcggatgggattcactgacggttatgactgtcaccttagatgcgctggtgttagctacattctttttcattgtgtttcgtaatttgcaggctatgagggtaacaggattgctcaaaggtgcaattttagtagtaggtatgtggttatttgctaggttgtttagtctaaagatgactgagtccattgttacgattatactgcagtatgcctttttagcggtcattattatgtttcccaaggaatttaggggtatgctggatcggtttgggagaagaaaggtatttagttggaatcgggacaggttaatttcaatggagagcagaaaagagttagttcgatcaataatggatttatctcggaaaaagaggggagcattaatagtcattgcgagagaggacgatctgcagcaggaaatagactccgggacattattgggggaagtaaacattaaaaaagaagttatagatctattattttcatctgatagcgagctgaacaacggggcagttattattcgtgataatgccatagttagtgccaattcgagacttcctattgttgagaatcaacagttacaaaggtggggagcgggatcaagacatttgggtgcagtgggaattgttcaagagaaagattcgattgcaattgctgtgagtgcggatactggaaagataacattagtgggttacataggtaagaatttaagtgtcgatcttggtttagagttaaaagaatttaatattcaggcaggagtggatgaacaagcattattaatgcggatcgataagctaattcaaggtaagggagatagcaaaaaggtgaagagtaaaaaagtgaaggataaaccaatgaatactaaaaagggcaagaacaagcccgaaagaaaaaataaaaaaggtgaggataagtcaagtagcgggttttttagttagggggttttaggttgaaaagatctggtagtgtgtttgctgcattgtgtttaactgtgatggcggttggtttaatggtatataacacatatggaggagctgaggaatctgaatcagagttaaggaatatgtcggacaatcaggtataccgggttgataatgttgaggtagatgtaaaaaccagagaagggtatttggctgtaattaaagaatcgcccaatttaatcatctacggtgaccaggaaaaaataaggctattaaagaggaaaaaacaagttccaatagtaacagcagatacagatgggcgaaaagatggggagtactggttatcgccaatggtgaatgatagggtggacggactacactacgttattaaacccaataaagttaaagtaaatgtaattaagggggttaaagagagtgttaaacctaaagtcaaaattgatggccaactacctgtgaatgtgaaggttaagagtactgatgtgcaaggtaaggtgtccttgcttatgcttccctcgcaggttgatattcttgggtctgttgacgttgttatacggggcgaggacattaacaagagtggggtaatacgaggagacgtagtagttaaggatgctagaggggatcagttagataatgtacaggtgaaccaaagctccctcccagtaaaagttgatattgaataactgtttgggcgtacaaggatatatttgtacgccttttattgaaagttaagaagatatgatattttaataaacttttatgggggttctaagtagagggagtgacaaaatgtcaaaaaacttttttggtgaagcacataaagtatctaaaaaaattacagatctggttaggtctaataaggttatggttctgttaaacgaggggttatcagtaaactgcaaccgatggacagtaaataaagaagggaaagtcagaaaaataagtagtacgttaagtatgatacatgcatctgtcgctctacgagggttgcgtgttcaggggatgttatcgcatgaggacgggtacctggttccattagttgatggtgggtggttaagactcatgttaaccaaaaatactccgtcagggatgacgttgtatttagatgggttagcttatgaggtaacccttaatgacggttgttcgtatagtgtaaacgttgggttctcttcaaaggttaacggtgaggatgaaattaaattaaagatgaaaatgggtcaacagacaacggttaggtatgaataagtatagggggggtaatttatgagcaaggtttgggattacggggattttagtgttgttgatatgggtaaggtttgggggcagagaattttatggattagtgtaggtgaaaatgggtttgagtttaacgtggatagtgacgtaatggggagtagagtcgaaatagtggatagattagttcgttcatatgaagaaggattagatatgttaggcggatgtcgagatataaaaaattcgtatctaaaagaaattgaaacatttatttctgattttgaaaaaacttttagtaaggtatggattaatcagcataggcttaatacttgggagttgagtatggttggatgaggctacagatgaaattatttgggtgccagatggcttagtgaggtatgttgatcgtgttatagaaacagaaaggttgttgtttcgtgagggtattaaaagagggataatgaaacctaaatctgtatacaacaatatttataatctagtggtcgaattttccgatttagtgcggatgatgaattggcgaatagcttatgggtatataaaggtttctgattctaagtatttaagaagttgctttctgacgcagggggataaggttatagaccccgggagtttgttttttcaccctgttgataacgaagattattatacattcacagaacttcatctagtagagtatatcgatttgcttacaggtggattagattccgggttgccggcgttaaaagagacgttgaaaacaagggaggaaaagtttaaagagtatgctaatgagagaggatgggattgttatgggtagagtggtttgggtatgagtataggggatagaaatgtgaatggttacggtatcgaaaattatggtgctttagagaataaaatagatgatattaatagtgcagtgaaggggataaatagaaatgttgcaaggatagcgggtatgcaggagagcgacaccaagaggggtaaggtaattgaagaagtaagtttgagggatgcggttattagggttaaggagtatagcagcagttatgttggggatttatctcttgcaacaaatatttatcacgctcaacaactggggatgaaacttaggcagcttgaagttgatttgcacgggggaacactggcgtttgatggtggggcatttcaggaaagttcgggagacataagattcgggaaaataagggctaatccaaaggagattatacagggagttattcgaagagcgaatgaagaaacatttttcagaccaacggtgtctgggaacggtacggtttcattagaaagcagctttaaattcattcaattgctacgatttcaagaacctaaaaaagttgtgttagagaagggactctatctcgcaagtgcaggagattttaaatttagaacaactagaaatttcaatctaagttatatgcttttttccgccaagtcggtttttcagacagacgttaggggttcgggagttattgctttggagctgccagtacataaagatgagttggtaaagcatatagtaaccccagataaaccgtatagggtaaacggagattatgttctttattgggtaggggatcttgaaagaagggttaggaaatcgagttcaatatttggttcaattgctagtggtacggggctggttgaggagtactcggggagcgggtatgtaataactgcaccaactttagggtattataaaactttatcgagggatttagctaatacgggttacggggtatctgatcgtacagcagtcgtaggtgaggatgctgatcaaggaaaaagaaaaacgccgttactgaaaaaaatatttacaaggcagtgaataattcactgctctttttctacaccatacttgacaatacaatatataaatagtataataatattaataatataaacattgatactactaactttcttaaactttcaagagggtaggctgaattattattttaggcagtatcaaaaggagagataaaagtgataattgaaaacagtaaaattagaaatcgaacatatagagaagatatagagtttagacatgcattattggataagcactcacagttaatgcgtatgtaccgccggaataacaatattaaattggcaaaagaacagtttgagatcgttaaatctcttttcacctttttgaataatgtaggcgaaacaatgtcttattatactttagaagattttaaaagtgattctaaacaatttgaaaaaatatcacggtcacatgtggtgatattatgagagtagtaatatttatggatgaaggaaatattcagagagttgtatccgatgaaaagttagatgtaactataattgatcaggatgtggagtattgtgaccttgatggagtaaaagaaatcttgggtaaggaagcttacgtatatacgggaataactgagagtgatgtagatcctgatttggttagtagagtagaagaagataagaaaagttaggaataggtgtagggtacttagagagggtggggatttcaccttcttttttatttttatttgacatttaaaatatagtatagtatagtgaatttaataaaaattaatgtaagagaggtgaaattgatatggattatagcttaactatatctttatgggtggtgttgctgctgacactaggttggttaatgaaaaatgtatttagatttaaagtgggatttattaagatggcgctaattataactgctggattctttgtagccccgatgttggagggaacaatattgtcgtgggggattaagttcctggtatggacaatggtgattatgtacgcaataaagagtctgtttggttcgaaagtgtttattttcatctcaacatttgtattgggttgggtactgatgggtcggttcgggggagttttcgatcaaaagctacatcaaatgaaaaagcgttacgtcaaactttaattcaaaggtgagaatacggatgattatgaatacagggtaaagtcactcacaagtataagatcttgatgggtgactttttattttggataaaaatcggtaacatggaatatttaatgtaaggtagagtgagatcaaatagatgtgggaggtattttggttgttggacagggattatattagtaccgtaaccaaacagtttggtgtaacaaagtttccagtgcgaatcgctattcatatagttgtcttgaaagatgggcgcgaaggatttttggtgtctcggttaagtagacgtgggaaagtcacaaacactaagttatcaacaattcaaggtcttgtaagaaatgaagagattggtgctgcggtattggtgtttttgggggacgtaaattctgctcaggagtttgcaagtttgtgttttgagattcagaacacatggttaagacctggttcaaaaaacactaatattgatgctgcgggatacggatattggaaagattattgtaacaatttgaattatccaactagacggggtttgtatatcagtcatgattctaataaaggacgagtgatagcggtatcggagttggatgttaaaaaaagtatcgacaatttaagtactgaattgattgtgcctgatttttatagggatgaatttaattcaggttttgtgaaagtaattgatgcaaattccccacgggaattggagagagaaattcaaaagtgtggtcaaaaattaggagctaggtaaatcaaaagaacattccaactaaattttagaatggtgggcttattttggatattacagtagtgtttaaggttaacggtattgagattaaagctgtggggaaggctccggatgcccgaacaatacctgttgagggcaaaagaaatatggcagcaatcacggctatcagtaaaataaaaaaagaaacgggaattgatctttatagtattgatgaggatattaatgaaaaagcggaatttccggatttttgtgagaaagaatagagatgggtattacatagcttagggttgagataataaaatttattgataatggataaattcgatagagcgataatcaaaagaaaggatattaagtcctttcttttgttttgatagaaagtaatatttcagggggacaaatttttgttaggataagtttagaagaattgataaattttttatggaggtgaatgggttggattatgatcgagtttataaaaattttgatatgagtcagtttagttctgatgaacttgaggagtttggaaggaagttgtgtcgtcaagtcctattacatattggaatggttcgttatactgcggctaacatgaagactatggatctaaccgcaggtgatttgggaagaattacagatgaggcgcaaaagcttgtactgggtttagatgtaatgtcgggaatagaggcgtacaaagaaagtttgagagcgctccttgagttagttggggctatggaaattaaggagggggttaaggggtctatcaggaaagatttaaaaaagagctttattcaggaaatgcgggatatgagaatatcatttaataaccgggtagggtattgggatcaaattggaggatcatatgtcgatacaggagcaattagataaagttaaatttgatgacattattgatatattaagatatgagaatgatgttgagcagtatccatttttaaaccccaatggacgttatgaggtaagtgacattgttatttcatcgtccatgtatgtacggaatgggggttttgttcgaaagaaagagaattccatatttggtaggaagcgtttgacaaactactcttttattgtggacacaatagggtataacatgcgggatacagtaacaaatgaatataaaatggtgtctaaggaggaggctgccgtcttagcagtaaccgggggtttaacgaacggttatatgcgtatccggaaaaataagaggagcggcgacacaatccgtatagacccttacaaagaaaagataaaggggtttaccacagaaaaccgtattatttgtgggtttaaattagatgaaaacaaaaaattagttttcggtgacgatgggcgtgtagttattaatgtgtctgaaaaagattgcacccgagacttgtgggagcagctccaaacaatgcggctatcgaaaaggaaaaagtgcagtaaaaaactagcatttcgtaaagacggcaggtataaggttttaggtgcggttaccgacagttatatagtttactctggagttggggcaactaaagcgaaggttattggttataaagtagttgacgtaaatcttcaacaagtttcatacatcacccaagatgagttaatagagagggcaaagaattatggtctatgtaacgcctatgttattgagagaacaattcgtgggaagacgcaatatttaattcaaccaaacgatactaaaataacgtcattcacggataaaaatcggttggtgactgcatttgaaactgatgatgacggtcaaatacaggggttaaaatcggggaatttaaagctatccataaaagaggattgttgttcaaaagatctttggagtataatacaaaatcagaaagacaattatttgaaaaagcgaaaatatagagttcaataaaaaatctggggggaagttactatggcggtcaaagcaaaagctgcggataaggtgaaagtaaaaaaagagtggaaagataagaaatcattgctgatagttgatgtgagtgcagtgatgagatccaattttattaagttacaatctgagggtgaggcattatttaaaggtaagtttgctaggcaaccattatcttatgaggttaatggtgaggaaatgaatacatctgcaatgtacggactatttcgtttgtttagtacgtttggtttggatcatgattatgtattttgcttcgacacacctaataacttgttaaagaagattgatgagaattacaaggcaaatagggttaaaatgggttcggagtattttgatcaggttaatacatgctataaaatccttgaggaaagtgggtacagggttttagcggaatcggggtttgaagcagatcatatggttcaccaagcggtggatgataattataagttttatgatgttatcggtgttattacaaatgatcacgatttgtcttgtttggttgatgagaaggttagttggttaaatgtattaaaaacaagacctgatatcacgatcgataattatccggaaattaataagtgcccttacaacagcatcctattaaaaaaggctacagttggggacaaaagtgacaatattgcgggtatccgtaattttggagaaaagaagttttttaagttcatagatgaagaaggtctttatggaaccgatatctatggaaatgaagaagatattattaaaaatgctgttacattaaccgatgatcagaaggaacaggcgttggcagcattggatttaatttacccatatgaggtttcggtagatgccagagcaaaaaccgaaatcaacaaaatggttataaaagtgtttcttaaaaagtatggtatgaatagcttggtaaagttatttgaataggaggactgattgttttgagtttaaaccatgaagatcttgacatcgtgaatgaagattttgatatcgtaaataaggtagagggtaaacctgggctggatctggaagagggtcggtataaggtagtaggtgctgttacggtaagtccgttgttcacaagaaaatctgctgggacaactattgctccggctaagggatataaaattttagacattgaaacaggaaaaacattgttagtatccaaagaagagggagttcgtctatccgccgagggtggaacacgaaatgcttatattgtgactaggaagcgggagaaaaaggataaagagactggtgaggttattaagactgaagaggcaatttatttgcaaccatatccagcacgtagcgaagctttcacgcaggacgatcgcttagtgactgcgtttaagttagatgagaatgggcggcataaaaaaccgcttgagttaactattactgaggaagaatgctctgagaatctttggagaataattaaagaggaatacgataaaaagcttcgtggtagtcggactaaaaaaagcaagaggggatcgcagcaggatcacacacaaatgatgagtgatttgaagaaggctttaatgaagtcatcagcggttgcggtcaatccatttaataatcgaaagtaggggaaaatgatggcggtattgaggttagagaatattgcaaatacgttgaagcaattagaggagaaaggtcgtactggcgtgtacgaccttatggcttattttggcgtaccttttgtaacaagtttaggttatgaggtattggatttaaataagacggagacagattgggaaaatgggacaatcacggtagatattgatgatcggttaaaattagtgttttccttaaacggtcagtttcctaagaatgagtatgaaagaatgtttcttgtggctgatgtttacgatcagaagtttgaactacactttaaggttttaggtaaatgggagaaggtcgctactgtttctatagataacgttgacacgcagagttacatggcgatgacgaagtacacagcgagagatcatgtagtaccggcgtttaaggaaaagggagaaaggttactgactgagggagttattaataaaaaactagaagatggggaagtttataatgattttctggtacaggctgtactttcagagctttctaacccgtcagatgatatggtcaagctattagcgaatagattggtttcagattatacaactaaagatgttgaatgggttgagggtaaaatccaaggaattaaagatgatggtttacattctgttgtatccgagctggtaagtatcggtgaaattgatggtgttcgtaaaggtaataatgatgtcgagatcaatattgaagatgatgaccaaatggatgacaatgttgtggagcagtatgatgaagacatttctgcggatattgtgagagagtttagtgtagaacccaatttagaggctaatatcgtggacgactcggagttacataatggtggagatttacggttagatgacattggtgataatgatgaagaggacgacttgccgttaaacgagtatcatggtgatagtggaaatcaagatatgttttcacataatggggaattaaacttagatgaatctgatatgaatttaaacattgatgaagaaaactcaaatgagtataaacctaaagaggttgtgttgttagatgatgattctgataacaatacggatgctggggcattaaaccttgaggatgtattaaaacgttaggagtgagtgaagttggcagggggaactgacaatctttcatggacaagaaaatatcgtccaacatctataggtgattatgttgggaacgatgtaatgaaaaataaattacaagcgttaatgagagttaataagttaccgcagactatgttatttgagggtgaacggggaacgggtaaaaccacattttcacggcttttggctaaaacgatgatgtgtgaaaatccagaggacgggcaggcgtgtggagcttgtccgtcctgtcttcatttagacaagaattatattaaaacgggtcaagcaccgagaaatataccgatatatgagtttgatataacgaaaatgaacggtgttcaagatgcgaaggagattgtagagagaatgcgccagagatctcgtaactctgagaagagagtttttattttggatgaggtacagagatcttctaaggaagcgcaaagcacgtttttaaaaattacagaggaacctgttcccggtttgtatgtgattttgtgtacaaccaaccccgaggatttgttaacaccatttaggagccgttttagtacattcaaagtaaagcgtccaacaataaatgaaatcactaagaggttagcgtatatctgcaggaatgagggtgtagattattcacctgatggtcttagacttattgcgacccggtgtgggaggattccaagggagagtattagtcgtactgaattggtggcaactactggggctgtaactagagtaaccgtacagcgagagttagaaataatttcagaaaaaatcttcacagaatttttatctgcatgtaaatccggggcattaaataatgttttggatgttgtaaataaaattgaagaaaacgatatccaaacatctgattttatcgagggtttaggtgactatgttgtttcactgttaaatgtgagatccggggttaagttagatcagtacggagcagaggaaatcaagaaaatgaggaagtacatcaaagctttctcagatagggatattgtcaatatactgaaagtgttaaaggattacagtggattaaagaagggcatgaggttccagctgtatgctttgggggcggaaataatggatgccacaaatgtacctgaaacagttaagccaattagtgaggaaagggcaagtaagaagtatacggaggtaacagctgaggttaagtcctctaagccattcaaaaaaccgaaacctgcgtcagaggaagatattatgtcagtgtttgaaaatgctaaaaaagtcaaggagtgagggtgtgaacgggtttggagagaaaagcagcgcgtagggaagattaccggtctttaattaattatgtatctttacggggcggggtcagctataaccgagcgcatctggttgttaaaacattaagtgctgttttaaagaggaatgtaaaaaagggaaactctttagagctaccgggactatttaagatcatttttacgtcgagtataggaacaatctacaataacaaggttatagggttgaatgaccaggttgaggaagtatccggtgaattgaagtttagttcgcatgacgttagatctcttttgagtctttattacgaacggatgcgaaatcttgttgagatgggatatcagatcaatgtaaaaggtgtaggttatgtaatccctaaagaagataatgagggtgtttactgtgacacaagggtaagcccggcattaagtaagcctgaagttgcggacttctttattttaaaagaatctggggatctggaacttacacagctggggagagagaatttacggtttaggattgaacttgatgattcaattcggatcccgtttagggttatgaccggaaacaaacttcagctagatacggtagaaatttaaacgtgtatgggaggaagtttaatgggtagaggaagaaaggcaacaaatattttcgtatatgttgggcttggtttgttggtgctgtttctaatcgtgggtatagcagcgaagaagtttatgtaatatgatgttatgggacgggcttttgtgccgtcctttttgtataaaaagagaggagatatgggatgagtaaaaatcaatggttagcgttgtcaggagggttagctgcgcttgtgctaattgttgttgggtttgttgtctgggggaattatcataggcagctggacgaagactcaaaagtagcaacgaaggagcaaaaagaggtagctgaaacgagttctgacaaattatctgaggagttgggtgaggatattccaactaaagaggagttggagcaatacattactaatttggaaaaaagagaaggatcactaacacaggaagaaaaagttgaaaaaataaagggtgagtatggggataaggcagcagatctaaccttactgggttatttagttagtgaagatatgtcattgaaacaggcagatgaaatgaaattgcttataagaggtggtttggacgattctattatcacggggattccagtggaaaaactgtcaaaccctttaggagaaagtttaaaagcaacaccgacggatgccgggtataatacatctgatttttcatccaatactgaggggttctctaaggaaggtagttggtacattggatatccaagggtatccccggatgggttaataaaaacattagatggtgaccaggggacgtataaagaatacggggaagtatcgttttatgcctatacagataaagacgtctcagtaagagaagcttcggatcagttgagcaaaattgacgtaagggttagtgggcacaaagcagatcctgcagggactttagcagaaaagaaaggaacaatctcggaggatgttaagggtcggggagtgtttagtttattttccggtattaagaaaaatcaatggagcaatgggaaaatcgcatcgggtgcgattgttaaagtttcatatgaaatgccgatgaatagtttactaccggatggaacggatccaaaaaatgttgacttaaacacatttgaacctgttttaaagattggaagtctagattacaaaattaaggcgggaagaaacaatcccggagatgtaatgcttacaaaataataggatagttgaaagcggtcaggagtggattatggatgttgtaccctacacataagaggtacggaattctatggggactattaatgttccccataggtgtattactgggagttataccgatattgtcggtaagtatgagacctacagatatttttatgttagttgtttgttgttatttgggtatgcgtggggcgctttttggtgctgagtttccggacattgacagtccgggttcggttcctgctcacaaacacccggttattaggaagatatttgagtttttccatgttaagcataggggaaaattttctcatgattatttttcacttcttttactttttggggggtcattgtttgtcttgtcttttgcagggagacgatggatagattcgattgtgtctgggtctacactgtggggaaccatatcgtatatgagtttagtggtgtttgtgtggatggttgcgttagatttggttgattttctaaagtggttagctaacttaatgcaaaacagaagaatgtgggcgattctacataaaaagaggtttgttatagggttttggaatgtggtgtggttgtctggggtactttgggtggctggagtatttaagttaggggcattgtttacaggaaatataaatttaagttcgggtattcagtcagcaatgattttgttagcagcgtttaaagtatatattatctttgcttgggcgggggcgtatagtcatttgtttgcagatatgacaactaagtcaggggtaagtatctttttcattcctgttgcgccggcaaaggtagcattgaagttgaaaaaggttccacttgtcggaagactcttagtccctacagactttaaaacaggtacaggttgggaggatcttaaccggtatgtggcgacggtgttatgtgtacctgcttttattttagccgtattagctctttccgggtttgatgtgagcaaagtaatgcatgtagtgcttggagcaattgggggtgtttaattttgggagttgcagataatattaaaaaaatctttgcctatgggaaaaagaaaaaccttgaacgacgagttgagaatgaggctatacgagcaagtattgaggaaggaacgttttattctgaatatagttcttttacagttggtctgcaggagatgttagataagctgcttgaaacttatgggtatcaaaaagtggtatataaaccaacgagacccgagatggcgaagtattttaaagcagccatggaggatccgcagtttgagccaaactatgttatggagaaaacggtgggtggggaattctctttccgattaaagactatgagtgagttaacagaggcgtcagatgcagcaataatggaagatctgcattaaatgtagttgacttttatagtaaaacagtgtatattgttcatacagacccttgtaggtactgtagtagccagttagattcggtctaactggctttatttattgtgaacgaataatgggtatatttatgattactgtatataaatgttgatcggaaagtaaataatataaatagagatggattgggttcgtaccaatttgaaaaaaggtttatggttgaggattactttattcaattgaggacgaataacaccgtgtagacaaacgtaatatactgatgagtgaggtgttggtcatgggacggttaaagagagatgaggttttagaggtttataaaaaacacccagagttaaacacagccgagattggagaaattgtgggtgttaacaggcagtatgtaagtaaggtacttaaagatattggggtaaacccaagggatcggcagaagcagttaacggatatgagatttgctaaaaaggttaaagagtttgaagaaaagtacagtattgaaaaaaccatgatggatatggctaaggaattagatgtatcaactgcgtatattcaaaagatacagcagcatttgggtgtatcttttcgcgagggagctgcagggagatacaagaaaaacgtacaaaaggttggagaattatataataagggcatgaccattaaagaggtatctgagaagttggatctgtctgagaggtatgtttcaaatttattaggtgaatataaaaaagaacgtgaagcagaggggcgagtcttatgactcgctctttttttgatattaaatgggttgggataacaataaagctagatagtcggaactaggataaatagaaaagggttattgaggtgatggtgtgagtaacaaattattttggggttcattggttgggtttttagtggttttcctgttggtagctatttttattgtctttcaagtaaaccacgaaaacaaggctggaagtaaagaagatagtgtagacaccagtcagtacaatacggggaaaatgtctaaggaggaaaaagaagaactcgaatcccatattgaggctgaaaaagatgtaacggtggataagcgggatatgaaaacttttctaaaggattatatggatgttccggtaagtacgttagatatggatacagccgtagtgattttttataaaaaggattatagtttctcagaagagttcaaggagaaaattgaggagtatattgataggggaggggcgtatccggttaagtctacatatttaaatgttccagattcgtatgtagtggcgcagcaattggtgagagaaaacggtttaagtacggatccattcccgttagctatttttattaaggatggggattttgttagaagttttgatagtttagatgaattaagtgaattgccggtgagggattgatatgtgtcgtttttatcgagttgtgttgggtgtattggtagctatagggttaattttagggttgggtgtgcgtgctgaggctgctagtttaccgaagcctaagtatccgcaaacagatccggcaaagggtaccgctccggagtatatagaaaaggctattgcaaaggcgtttgagattgttaatcaaagtccatatacctggggaggggggcatggtaatgaagcgcagtacaaccgtgttccaccacttctagattgctcatcatttgttcactgggcgtataacaggggtgcggggttgtctttggttagtggggtaaatagtgctggtacaaatactaaatcccttattgctaacatggatgtccgttatggtgtagagatcaaagatttaaaacgaggagatttaatcttttttgatccagatggcggaaaaaacaatcatgtcgggttgtatttaggtgaggggatgtttataaacgacgaaaacaagtacggggttgcggtagattcgttaacagagggttattggaacaagtggtacaacaaaacagctataacagttaaggaagggggaaagggggttaaaaaaggtaaggcagaacccttaaaaaacggaaatgttacaggaacaactgaagacactactaaatcaacaacaagcagtgataaggggagttctaaatcttacttcaacccgtttaaatccagaacatttgcggtcaacaacgtgggggttgtcggagcagatgagcaaatgccggcagatgtaagtttttacgtatctggttgggttaaggatttttataaggtaatgttgtgggttgcaacaataatttcggcagcgttttttgtatacacaactattagtgtggtttggtactttgttatgttatcaaattcaagtgtaaggggaatggatacgtttgagaaattaacaggtttagattccgataaatccataagaaccaaattaaatgttataggaagatggggagcgagttttttaattataacgttgtttttaacgggtttatacgtaccgattatgggcgctatgtatagagtcgtagacggtactgggatatttggttgagaggacttagtctatgaaaaaatataaattgattatcagtctagttgttttaatgatttgcagtcttttttcgggtcatacagcaagtgcagatgacctgttgagtaagtggaagggttttgatatccggacaaaggcttctgatggagttacagcggagaaaatcgataaactgtttgcgaaaaacgggtctggggggaagttagtcggtcagggtaaaaaaataatggcggcggcggaggcaaacggtataaaccctgcctttattgcgggtcagatggcttttgaatcagcatggggaaagtcgaatttagcaatgaagaataataattttgggggaattaggagtaagtcgggttttccaaaggatggtaatggttggtcaatttttagttcagtggatgaagggattaaggttcaagcagaattattaaaggattatactgaggggaaaatagggtctaaaaaattaacatcattttgggatatacttcaggtttacgctccgtcgtttgagaatgaccaaagtttgtatgtgtctgtagttgcagggacgatggacaaattgggtcaaactcccgatggtagtctggcaaagggtactggcgagtataaagacgacaaaacgcaagttggtgaacgaactaagggtataaacttctttatggagcctgcgttgggtcgggtaggaagcacaggtatagattctggggacagtgtaattggcagtgatgcgttatatgggtttggaactttttctaaaaagacgtatgggattttattgattattgggatggttttagccgctattctatttgtatatatgtcagtaactgcagcaatgtatgcagcagcggttaagggtttagcgagtggagtggcgtttgaaaagatgtctggaataaaagatgatgtttatgggaagcgaacatttacgaagctagtcattgcgatggtaattggatttatgttgtgtgttattttcatgactggattatatatcagcttaatgggtgctatataccaggcagtgatgtatgcgtggtcgttattatttggcgggtagaaagtacagatgattggatagaagataatagatcagagctgatattttttagtctcatgagacgatgtagtgggaggaggaaaacacatggttttaggagcggttgatgtcggaggtcaaagtggactttcggatatcgttcaatttttcaatacgcagtctgctaccggtgatgtatccggagctttagattcctcagctctagcgttcaagatttctatgtttgtcatcatgtttgttggtggtttggcaatggcgatctggattgggcgtattgctgtggatattgctgcgttagctacccgagggtttggcggtagtgcgggggcggttgataaaatcgctaagtttggaacaggtaaatcagattcctatgaaagcgtaggggcgtatttaaaaggtaacctgttagaaatcattttaatgattgtgttaattgcatttttaatgacaggttggttgttccgacttatcgcaatcgcactcgatgggtttggaacgttgggtaataagctactaggtttggatattgcaggtggacttgctagtttagatgctgaggcgtttacagaacaagtacaggcgagacgtactgcgagtttacgtggtgagtatgatgatcagctttcctcagcacgtaaatattctagtagcttgtatgatcaggctaaagatggcgctgtttcagatgatccgcaatttaacaaaacaaagagtttgtacacacaagcaatggtcaaagctgagattttagctactgaattaaataaacgtggtgcagcatctgagcttaaactgggttctagttactttaaacaacatttgagacaaaacggggatggtgtttgtaacgcgaactttctagtgagcgatgtaatgtctacgtacagtaaaaaaatcacttgtaagaagtaaagttgtaagggtgtctcttccgtttggagaggcactttttttattgatagtgatgataggggatagtgaaccgatagcagttaaactaaaacatgtaataaatgattttatggtagaagaggtgaaatggatgagggtagccaaacggttgttaaccgggctaatgttaagcgcagtaactttcactgggctgatatctcctttaggaaatctggcacgagcagatgatggtggggcagataagaatatttataaagattcaaacgctaaagtaactggtgctgtgaatgaagctgcctcatatagtgaggggatgcagtacttagttacatactcaattctccacagcatgtatggatctactggatccgaatctgattacgggaaaatttatgatggggcacaacctacaaactctgtcgataaaaataacccgtatactgggattccggattttgcttttggtggaacaaaagtctatgaggcggctaaggcagggaagacggagacagaaggatcgaaggagtcctccactgttgaggacaatgcaaataattatgataagaaagtgcagaagcttgcagaagagatggcaagtacatatgtagattggttagggcagtattttggtgtaggaagtgaagctataaaagtatctggaaaggatgacgcttggtataactggggaggcgaaggggtcagtacagttgtaagaatggatgatttagtgtatgactcacgtaaaagcgctaaaaatccggtatcgggatccagcagggaattaatgaggaaagttattgttaattacattaaaaagtcacttggggtgtctgggtctgctgctgaggtttataagggtatgacgattgacgatagcgttatggagcaatgggtggcagattatcggagtggaatttcgacgtcaaaacctgtatctgtaagtcaggcagtaaatcaggtaatgtttgagatatccggtaaaaagacgaatacagatgcaaacaaaacagcacttaaaaagtatgcttcgtatgttccagaagtgaagactgagatgtattcaagttctgataagaaggcactaaataaggatttagcaaaaaagaaaactgattactacaacaagattaagggaacttcggtgtggaaagattttgctaaagcgaagaaggcaactgaagaccaagcccaagatggcgctaataatgttgcgagcaaaaaactaaaagctttggcttggatgcctttaacccctagcttaaaaaatagtgatattaaaagcgacaaatccttcgtagattctttgagcaagttcgatggaagtaaattcacggacacacggctacagacaaaggatgggaaaaaccgagcagttcaagttaatgacctatttgcaggaaagaaaaaatcatcacctgttttcgtctacaatacagataaatatgaaaacgattatatgggaatgttttttggaggttcctcaaaacaggctgatgggtcaagtactttagggaggtatattgggcttgaaggtgaaggtggcaactggctagggtctgctgggaaaattaagacaagatccagttcagatgatacaaaaagctacagtttggcacttatgcaagcaatcacagcggataccgctgggaaaaactcattgaaaatggacttagatacaagtgggtctgatacagtaggtattgataattatgggaacattattgatgccaatacggggactgttttaattccttactggcaaaacagaacagttagcgaattagatggattggcttccgggggagagtttgtatcgtcctcagttttccgttcaaataaacaagggtttgcaaaacagtttaaggacttaaaaatcggcagtaaagtatcgaaagtcaaagaaagatctgtatccgatacggcaatcgaagcactggctggatcatctgcagcaagttcagtcaagagagttaaaaacagtattccttcaaaagtaacatatgaagatatggcttctttagtagctgccgggggtaaaaacgcagctgaaaatgaagcaaatatcagagcgttggctttaattattactgcagggacatcaaaagaggttaaaaattggaacgaatcctttaaaaagtactctaaggacgcaaaagagatgtacatcacaaaaacagatggcggttacggtgatggtacgggaaattctgattcggatgcattggctgagtatacaaatgccgatttaagagaaagaattatgatgattttagatactggcttttatgaagtacttaggttaacgatcgcaagtatggtggttagtatttacacatcatcatttattaacttctctatgagttcagtgttttatactcaaactattacgcagactgctatgtggtcagatttattgagttcattgagtttgcttttaatggggattaccggtgtatatattatttttatggcgtttaaagtttttcgaaaaaccatgtctggaaaagactttgtgcggcaattcatattgataacatttgttttagtcattccagcacagatatacggacccctaattaactttgtcttaaatgtaccaacggataaagttgtcgggaaacaaatacagcaaacatctatacttgatacttcgttagatactgaggctaaaaaacgagaaaatgatgaatattatgctaaattgtttggcggatccacagagttaagggatagaagccaagattacgttatctatttctatacaactcaacataaaagtgggtttgatgttacaagcgagaatccaaacacagcaacgtttaaggatcaaattcgaagtatagaggcaaagaaaacagggaaatggaacaaaaatgatattattagggttggagttagtgcctatgacctttttgattgggtaaaggctacagttgataaaaagaaaaataaagatgaaaacctatttgaatggttggcagcaaataaaaatgaagatggaagatacgatggtataacggactatcaagaatatcacatcaatacaaacaaaacctttgaggcactaggggttaaaacaacgaatgggtataaaaatttaacggcgtctaatttatttagaatgatgtatgaagaagcatcaaatgacaaagtaaaggatcgcattcaaaatatttatctcgtatcagaggcaattaggaatggtgatcacggttcggatgtcgtaactgatgatgaaagagaagcacttatgcgggatctttcaatgactaaaaagagccggcagtcgttatacggatcaaaaaaatcagatccaaaagtatcctataaggctcagaaactaatggatgcgaatgggttagaggttcctaataatgactttttaaatttagaaagtgttgttaataagttggtgccatatagagatccaactacaacaactttggatcgggatgtatatgacattaatagaaaagttctggatgactatgttgaaacgtattcagtagttagggaatctattggtggggacggagatcaaagttttaatcaatctgaatatttgatgatgattttagatgcctttttcgcaactaataatacactcgatcttcctatgtttccgacaacatatcagcctgagacagtttcattcgatagttatatgagaatggcgtttatcccgttaaaggagtttacatcagataatgttgaactaaataatgtggcgcagtacctagcccttagagataacccatttgtactgctgtttttctttctaccggcgctggtggcacttatggtgtttggaatgatcttcatagctgtattttatgtagttatgatggttgttatggttatctcgtttatttggcactatgtggtcaagtttgataaaaataataaatcttggttaggtgctttgatgattatagggtcatttgctatagccaagtttggtttgatacttctctggaggggtatgtcgtatttcttgaattatactaccgtcaataacgggggaatcacttacccatacacgttaatacactcattgataattgttgcatacattttctttatcgtgaaatatctccttctaagggtatttaaagcggtattgaaggataaaggaaacctcggtggggagttatttacgaagggtgtcagtgaaactataagtaaattcggaaacaaactaaatggtgggctatttgggggaagatcttctggaagtccagaatccgcaagcgcaatagatcatacgttagggaatgaaggctctgacggtaagttgttggaaggaattgccggaattaatcttggagggttggctaagaaagtctgggataagtttaaaggtgacaaacacgatgctgcagatattggggaatatattaatgcatcagttaaccaggacaacttcggtgctaaggctaaaaatagattcaaaggattgacttcgggagctgcgggtcgtgcgatggagagtgtgttggatgacttagatgagattacagcatccacttctggtctatctgatgcagcgttatccgctctaaaagattctggtcaagtaggtcaaatcctacaatcttctgcggatggttcaataataacagctatgaatgcggacaatcctgagcacgctgagttgattgcaagccatctaagagatcaaggtataaatgctaaagtagatgaagacaatgttgtttttgacagcagtaagttcgatttaactgatgctggggtacgtaagggattgtttggtgatcttcttccaaagctatatcaggaagttgacggaaagtctcaaattgaatatcaggacgtagataacccgttaaactatacgaaaaatgatgatggttcaatttctttaaatgttggagataagggtctatccccaaaatccttaaatactctaataaactctaaagctttttcagattcatttgaaatgatcagccctccggttaaagatgctaatggaaatttcattccggggacatttgatgtggaggctaaaacaggggttaatattcaagaagcagttgaaggtttatttaagtctgacacagcgatgagagaagttaatggtgaacaagctagaggttctttaggtttagacaaagcaatgacgtttaatgtggaagatcctgaaaatgaagatttaatttatgatcacatggttgacggcatgaaattgcaagacggtcaagtagtgtacgatagtacagaccaaactcatgttgcggctatcaataaaatcagcaataaacttagagcaaagacagacattcagcagcaggataaaattgatttaatgagaaagctatcctcgcagattgttatgggtggagataatggattccaggtagaatctatttcaactgctggaaactccgaggcacaggagaaagcgatgtcgatggggcttctacacgatggggtaaattcaacagtgtttgccggggaagatgcagctaatattgctacgaatttaaatcaagttaaaaatgtaatcaatgcaaatccacagactgttactgaatttacacaaaatcaagaagcactctatagagctggtgaagagctgatggttggtaaaaaccaagattatgataaagcccttcttaaaatgaatacttttgcagaagctaataatgttgatgatgggcgggtaacaaatattatgaatgattatcagaaccttatcaacatgaaagaaaataatgacatacgcgaggttgaatatacacgagaggttgaaaaactgatgagtgatatgcagactacgttgcaggatcacggtgtatatgaaaaagcagtttcagaagagttaagaaagagcaagtccaaagagagtaaagaaattctcgataatttcatcaaatccaaaaaggtgttaaaagatcagggtattgatacgaaggtattgagtagtatacaaacttcggatttagatacgctgggtcagttgattggagatattgaggatgtaagaccgggagaggatggattacttaatgtaacatcggctagtcgcttagatgagggtgacacatcccgattaattgaacagatgcaaaggttgcacttaccatcttagatataaatgagggagtctgatagcagattccctcatttatttgtttatatgggatattaaataaagatgatgaaacctaaattacaaatttttatatgctggaagctgattgttagaagggagacgaattatgggatttttcaataatccgaggaaaatgttcattccgttaagcatagacaatgctgaatcagagaggttaaattatttcttttcaaacaaaaagatggtggggatgacatttgcccttataccgtattttatcctgttatatccgttgttgcagggtggagttaaggttttagctttagtaatcgtaacagttgtttatgcggtgttatatttctatttcattcgcttctgggttcttgaggaaaaaaggttgaggcggatggttagggagttggatgataatcgtgtaagtggagttagccatttttggggtatcgacaaaattggtggtggtgatagggataatggaattatctactatcagcgggatggttcaaggttaaaaagagggttagtggtgtattttgatcgagggtctacagtgggtgtaccgaagggtcactatgagcagttccgtaaaactaaaatggagtttatgcgagagttaggcaaaagaggaatgaattttcagtggtatgagattcaaaagagagcggagatgccacaatcattaatacattatgcaaacatcttaaatgaagaagacaatgatatagcacggaagctattaaagctgcagcttaacataaatatggtatacaccatggatgcggagcagaggtacgttgattacattgtcattacaaacaagaggtttgttgttatgaagaggtttaaagaagttattcaggatttagttacaacaaagcttggcggaaacagttatatagttgaccccaaaattttaaacaaggaagaagtagaagagttttttcaaaacgtgttaatgattgattcattggatagtgatttcattagaaaagctgtcgaagtacagccatttgaaaactttgcgagattgcaccaggttattgataaagacgggaaaagtgttccattggagttacttgatgatatggatttaaattcacctaagtatcgtggaaggtctttagaggatgcattgagttgggaagagaaacgtgaagaagctaaggatagggaacgaattaaaaaaatggagtatgagttggagaaggctaggattaaacgaaatagagatcaaattacggctaaagagtatgaggaattaaaggaagagattgagaaaaagtttgacccggaggtttatgatcctgatgcagataaaaaggaacgagatcgtattaggggcgagaaaagaaaagagcgtgacagagaaagggcaaacgatcaggaacataatgacttggtagaggaaccggaagacacaggttataaagtgataaaagttgtggatgttaaacaagacataccagaaaccgagggaattgttgacttagatgtatcgttagaggatttggttaaaaatgagagtgaagattatggggaatctgatcaaggatcaatgtcattagaggagctattgagggattcgaatagaggataatttgttggaggtattgattatgtgggtattagctggtggaagattaacagaatctgtagcaggagcgttggccggagggagttttaataaacggtctgttattggtgtagagagtgtggatgatattttagaaacgttaaggatacatggggcaaaacattttgacagagtgtctgggttcgttgtgtttgatgctgcagtatcgtcattaaaaaattgggataatgtccgagaagttgcaagggtgtataaggataagcctgtagtggttgtaagtaggtatagggatcttacacctgacccagacagtatgggtggaaatgtaatagtagagtgctttgatggggggataccgattggtgcggttgcaaatcttatagatcggttaaactccggtaacttgaaaggagttcgagtttagtggctgattacgggttagttgcgggaagaaaggcaaacaaactaatcaaagagaagttttttggtaacactcgggagttcaacttcccagtagattatgattcaacagaggatcttcgggagtctctattgagagcgggaaccttggctattgagtcgttaaaggcgattttgattattgattatgggtttaaaaatagtagtgatccagatgaaatggcaaaagcgtttgttagtctgcaggatatgtttcgaacacagagggttagaggaattaagttatacctaatcacgaaaaactcagatctttataacaagcttgacggttctgtggatggggtatccggtactctgtatgaggatgtagagattttcttagttgagcaggaatataaaccaaaaacaatgcaagacattttaaagggaaaacaggatcgtatgggtttgtacaacaaagaggctgcgatgcaagatagggagtctcgatatgagagggagaaggaggagtttattcgggactcccgctcaattgatgacgatattttaaggtacgggaaggatgaaccggttagtgacttatcgaaagttgattatgcggattcgccggaacgacttaaaaaagtagctaatagagaaaaagagattaaaagaaaaaaagacaaggtaaagttaaaaaaggactttaatgttaaaaaggttaccgaatatcgggaagaacctcaaaaggaagaagttaaaaaaatcaatattacaattcgggacagccggttagatcgtgcaccacaaacaacagaagaggatctattggatgttttgcgaaatgtgtctggcgggtctacaagtgttccagttggtaagcttgagtcggattcgggtgttatgtcattcataagcgctcctaatgctgggggtagtgggttagtggcgaatgtggcggacatgtatgctatgagtaaaagaaaggtacttgtagtcgatttagatgtgcaaaagcggagtcaaacactgtacttcaaatcatatgagaaagcggttagaaaccatcaaggtatttcaaattcattgttgaaagtagcgcaagggggaaacattaagggcgctgctgtatcagtcacaactaagatagacgtgttatcggtttctaggaacgaagatgttgagattgactacgcgaattggattggtggggagttagcaaatattttaagcgatgcccgggaactttacgatattgtgctagtggatatcccttttgtgatgttggattattatattcagggacttgtggcggtcgatagaaatatatttgttgttgagaacaagttttatgctattgaagacttttttgtgttaagtgtgcatcggatgttagaggagaatcagtttgttatgggtgaacttattagaaaatcgtcggttatcttaaataagtttattcacggtaaccgagacgaggaggggaatgagttaaatcataaacagcttaaaaggatgctggatgaagtgggttatccttatgattctatgatggttgtgggggaaatcccgttctatgaaaaatgggaggatcagtttcataccggcattaggtacctatgggaagatcggttagcgttaggggtatataaacgtgtgtttgggaaagtggtgctgtaagttatggaggggaaaaagtatttaaacgataatgaaccaatctggctaatcacagaaaacctaaatgttaagcaggaaattgaggatggtttaaatagagaagtggtgctgttgaggactctttccgatttggtggagaatgttgaattggctacaagaggtgatcgtgttgtagccaatctaatttatacaaacacaatgatgacggagattaaggcgaatttacgaaaggtcgttgagttgataaatgtactgactgatgtgactgtttttgaagtgggtacagataagacatttgatggagcaattcggtttagtacagttaaaaagatgctgttgtttgcaaaagaggcgagaagggagagtcaaatatctcaactggaggatagtgatccgaagacggaattaatagaggggttacagattgatctcagcgccgcaaaacagcagcttgagaaggtaaatacagagttaaaggaaacccgagaagagttaaaggctgcattggatgaatgtacggatttaaaaactcaaataaacaatgtgtatgaggtcgatcttaaacttaaaacagatttagttagtcaattggaagaaaggcttgcggatttagagagttcattgcgggtggagaaagagaagtctgaggtttatcgggtagagaaagatgatgctttaaacgaattaacgaatttaaggtttgacattacagccttagagaagaggttggatgataggaagaaggaaaaaaagattcttgaaggaaccatttcccggcttgagaggcagataaatcaggttaataaggaaaaggaagagatcttacgttcgagggttgatgaggaagcgtatgtaacaatttctaacgaactagataaagaacgcaaaaacctaaattcggttaaggcgcttttacagcaagaaaaaataaatagttcaacaaaggacttaacaataaaggagttgcaagaggagatagatgaattgagatctggtgcggatattttaaagagtgccggaagatcaaattatttagacaagtataagtttgcgtctacagatttagtttatataaaagtgtttatagaacttccgtatcacagattagcagttaaaatgctctttgataaacttgctgagagagtagatggtgtaagtcatttaattattttaagaaacgatgagggtttggataataaatattttgatggggtacctatattcggaaaaataaaagatgcacaggtgcaaaataggatttttcgtttatacccaaatcgagcgatgtttacgggtgcggattcctggagcaaaaaggttaagagattagttgttctcgactacataaaaagtgatcagtactatttagaatcccatgctaaggaacggtatatgacggtggtggatagagcaagtaaaatcgctcaatatgggttaagaggggcacctattagtttagatgctgagtcggtatttgatattcgtttcgatcggcatattgctgaatcgcatgtaaaacaaaacagaagaggaattttagaaaagaagatagaaagttggatcaaaaaagcggatttgtagggggtttgttcgttgttcaaaaggaataaagaagataaattaacaaagagagaaaaattagaaaaatctgggcggaaaaggaagttggatctggggtttttggattcaattaatctatatacacggcttgctgcggacaagttaacccggggaggtatggatgtaccggacagggttttgggggatgggcagttttattactctacaaatcgtatatttacccgaagaggggttaaaaagatgtttttcatccatgatttaccctctgaaataaatagagggtttgttacggatttaagagctgaaattaagagggaagttcatacgtataatgaaacaaacggtgtcgttgaaaatgcgtctgttacattggtgattaattcagatttttataatttggattttggagatcgtagggtacaaggtcgctggtctaactttacaaggcagtatgaaagggtacaaaaaaacgcacaaaataaaaaactagaagacgagttaaagtcggataaatatagcgaagcagtggtaagaaaggtgagatcgtttttatatacaaaagaagctaaagatgagcagaatgcttctttttttaaaacaaaagttgttctagagattatggctacttctgatgaggtgcttgaggttgcagagaatgcattaaggggattctgtttcaggtataaaatcaaaacaaaagaagtctttgtgcagacgaatgagtatcaacgagcttttaccccggcagggagtgtaaaaaagtctttattaaaacaaatgaatgagggggatgtatgggctgatgatacgttatcctcattcaccgtaacaacgcatggagtagttggggatccggttggtatttaccatggggtagatattcaatctcggggtatcgttgcttttgatatgggtaaaggtgaagatgccaaaaacgtgttgcttgctgcgggttcgggggaaggtaaaagtaattacgcgaagatgctgtacactttttatgcaccggttaaagagtatgctacggttgcttttgattttgagggaagcgagtatatacctttagggagaattttcggtgcaaatgttattagtatgagtgggcgtgagggtaggtatgtaaatacggttgttattggggataagacgggagatccgagtatagataagtaccggaaaaaagaagcaatggaagcgaccgctagggttttccacttacttgttgatgagcggtatggcatgacagcggagcaggtagctatttttagtgatgcgttaaatgaggtttatgctgatttcggagtgacagaggatgaggagacctggtcaaaaagtaaggacattacgtacttccatatttacgcaaagataagggagatgaggtacggtcgtgagaaaaagtatattgaaatccatacacaggaaatactcaataattttattgcgatacttagacctttctttgaaatgggaggactgtataagcattggttcgagtcgccaatatcgttagatgaggtaatggaagcaaagcacgttatattcagttttggtatgggaggtacggatgaaaaaagtgttgattcgaaggggttagcgctgaggcagatgttcgccagttatctaacgcttttagtggcttctagaaataaagcaagaggagtcaggactgttgtgtttttggaggagctgcagaggtatttgaagcagagatactccggtgaaatagtggcgaatttttcatcaggtgggcgtaagttgggtatgattgtttattacataacaaactcacctacggcactactaatgcaagctgaaacccaagatgatgtaattttggacaatgcggcaacgattatgtctaatattaatatgcagattataggggcgttaagcaatacggatacagaaaacctcattaattattttgggttagagaatgctcgggggtacttaatggagctttccaaggtacatgaaacaaatcaaaagaatgcagatttaaaatactgtttctttgttaggtataggggtcaagcggctattgtgagaatgttatcgcatcctgatttagctgatttaccactatataaaacactaaacaatgccggggataaaaatgatctgagaagagtagagcatatggatgagcgggatgttgaagggggtattgtggctgcaactaaaaaagaagatgaaatgaggaaaagggatgctacgtttaaagaacgtatgcagggaagtaaggtttggtcataaacaggatatagaagaaaaatccgacacagggagagtgtcggattttcactggaaaatagggtttagttaggtaaagttaagtatacgggctaaaactataagatcgtgtgcacacaattttataggagtgttttagggttgtttgcccgagttagggttactaacaatattaatataccctattaaccggtatgtatgcaaggaagatattgtatagggttttattgataatgaatatgaaaacggagtcaggaagaggtgatagcataaggtataggggagggttgctcaatggggatgagtaaggatttaattaagtataaaaagttggttaaagcatttaaaaacgatacgagaatgtatcgagagggtattagggagatattcttttttgagcatgcaattgatattctggaagggacatctaaatgggaagagttaatgcaggaacgaatgaaaatcatgattgatataaatagagaatataagaaggcaaaagagagcgggcaattgcgagataaggtgaagttctataattattttcagtgggtggtgaatacccaagaaataagggagagagttttatgaaattaataatggatagtgtaatgatcttctatatgcttattttttcatatgcactgggtaggaagaggtctgatggaagtaatgttgttccaatttacgtgacagccatggcaattatatttgtattggctgtttttctcattttaaatatcccgagcattctggagctgatgcaaaattacgggggataggtcgaaagttaagataatgggtatagcaagagactagataagtattgggggttgtagcgtgaagtctgaactaacaaagcatgattggatttatgcaaagaaaaaagaagaacaggggaaggttcttcggtttgatcaaagcaactgtagggagtttccggatgggtttcaattgttaagggagattgagtcgcttagttctactgggtttgatgtacgagattacggtgaggctgaaatgattttgatggacttaaatgagaaattaaatagcaagccatataagatatcaatgcctattccggatcatgaagaagattacatcattcagttggataacggggtgagtatttggatcgagacttttgataagtatcatgggtgcggggagtctgattctggtgtgtgcttgatggggtttatgtttgaggactttaatcgagataacatagtagaagctgcaaaatggttagctgaggttatgtaggtgagggatggtgaggtaaagccatacatataggtggtgaatagttatgattaaattcacagaaaaagatttatatgaaattgaatatggtaagtttgataggtttatcaataaaaaacttcaaacaaagactgagtacaatcaggaatctcagttctcatcagatgacatagacgattcgggagatctggatatatcctcggttgtgtccggtgatccttttgactttggtgataatacaaatgacgactggtcttttgatggtggcggggttggttacggtgttgagcctggagataaaagcggtgtggcttcagcgcaagattggaaccgagggaatccggtaaaaacatttttgatgtcaccactgtttgtggttaagtacgtgattgtggatttgctgcaggagaaaccaaaaaaagatgagtgggaaggcattctaaaggcactaaataagataaatgttattgcggtagtggtggcgatattagtgttagtgctggggttaaattctccgttttctccggttacgcaattggtagtaggtttgttgtcttttgtgggaactacgctcactctaaagtatgtgtacaatagtgggaaattagcaacacaagaagagaaaaaggatcttgattttgactttgattcctcattcggtaatgaagtggattcagaattaaatgacttcaatagtgacacagatttgtttaatgatgtggatccagcaggtatggtggacgttggagatattgagtatgatgatgaagatgaaattgataacgatgacgaatatgaaaatgataattcattgccggaatcgaatatttcggtgagaagtgatgatgaattctatgaaggtttgcttgaggctttttctaaaaatcagaagtacatgggtagagaaatctatgagaggaagaaaattttatcttcattttccccgtacatcgttacaaatgacagatcctttggtaaatggaaggtacctaaagagaggtcattagaatacaacaacgttgcgtactcattatacaaggggctaatagctatagaaccaaaatttgaaaatgacgactctaagttaactgtgatggacattcgtaagaatccgcttatttataaaatagaagtacagctgccgaactatttcagtaaaagcaaagtggaatccaaggtaagagtaattgaggatattttacgtaattcagaagatgacagtaaggtatctgtcctagttaagttttttagagggaggtttgtttttaagttcctaagattagacaaccctaaattaatatcattgggggatattctaagattcaaagatgatacaaagggaggtaaaacagcctttgaggattttgcggatgatgaaaaggggttacctatgctactcgggttaaaaaacaatgagtatccttacattgttgatttagaggaaaacacttctggggtaataataggtggctcaggatccggaaagtcatggttaacgtttttattaggtacaaatttagtttttgctaatgattataataatgttcagtttatcgttatggatagaaaaaatgctccgttttggaatgcgtttgctcggtttccgcatgttttgggttaccatacggacacaaactcttatattgagatactgcaagaggttgtaaacgaaattgataggcggcaaaaattaatgaccgagctgggcgccgaggatgttaaggggtacagaaaggcacagaggaagaaaggaaattatgatgaactgaagaaaatgccgcttctgattgtagttattgacgagattacagcaactatgcaggatttcttagcgaaggatgataacaaggaatcgtacaatctggttaagggtttgatgtctacaatcacatttatgggaaggtcgtctggtgtgaggttgttagcgattgggcagagtgctgtcgatccttccttacctaaagatattaggcgtaatagtacattccggttcgggatgaaaatggatgctgaatccgactttaatatcttattcggtgatgaggctaaaaatgttactaaaccagcaagtgccggtattggtctagctaggacaatgggtgagtccggaatgcacatgattaaaacacttacggtaggtggaaccagtaatgagcagattttggcgttgttgagggttactgcgtttgattggatcaggaggagtataggggtcgatcagttaagtaaccctccggagggtatggagatatccgctgcgtttaatcgaaataagttcttagagatgtcgttaaaggagatggccgagggcaggattttaaatccatctgaggtgaataccggttacgaggttttaataaacgaggacatgaccccgggatataagttaaaaaagtatgaaagtacaggtatagaactgacacaggaaaaatcaaaaaacataagcttgagtaaaactccgaatgcaaacaagggagtagctgatgttgattatggtgatatggggagtgacgacgatagaagtggtttaagcttcgaaacaaagaaaagcacagaacccaacaaatttgatattttggatgaggttaacgatggtttggaatactccaatgatataaattcaattgaattgaaagagggaaaaacagattttaaggaaatatcggatttcaatgaagatcaagttgttgaaccggattggtgggattcgatagatgatgagaaagaagataatgataatatcaatttccaagaaaataatgagtcagaattagaggaagtagatgctgttgtttctaatactaatgatgaaacgggagagttatctctagaagatcttatgaggatggaggaagattctgaaaaccttactgaacaagggtgtgaagattatagtgaactttcacctaattatgtagaatccctagaaggtgggggatttaacggggtttcaacggataaagaacttgttcctacagaagttcacatggatggtgaagctgcggacaccggtgacaataaaccaccattggaaaaaactcaaaatagagacaaagataagttaggaagcaaagaaaatcaagaaattgaaaacttagcggtagttcaggaatccggatataagaaattgcaagaaatacaaaatcggaggaagcctaactctgctgcagttgaatttgattttgtagcaccaactaaaaaagaggaagtaaaaaatccggaagagtcaattaaacaatacattgttaaatatggggtgtctgatggaaacttcacctataggatgtccaaggaagaaattgagagtgtgtattcaaagcggaaaatagaagaggctttaaatctagtacttattgttgcggatggttctgattatattgctgaattatgaggaggggtgaaccctccttttgttatgtctgaaattaaaaaaagcaaaaaataagaaaataaattaatttgacaaaatggtatatttatagtatagtataattaataaacaaagttcgggaggaaatgaaattgctaatcaaaaaaacaggtaaccggtattacagatacagctggcaacagatgagaagtttcccaattaaaaaggctgaagctgagtacaagttgaatattggggaagctgaattagttgattcgtttccttctgatccggctaaagaggatgtagttgaaagtcgtagtgttggacatgaacaattacaaaaaaccaataacattgtaagtttggaggatttaagaagagagagggaaaaccgcgaaaagttagaaagggataaagcttattttctaaacagtatattacccaagctgagtcgggaggatgtgatccggttaagagatgccgcattagctggggatacagagttagaggctgaattgcacaggttggggttggctgtagaattaataccggaatcaagtaaaaaataatatgggagggtttaaccctcctttaacatacataagggagtttgtgtgaaaatgaggaaagaggatcaaaaaattgtatttctggagaaggacgatgtagaggaagggtattatgagattgtgatggatttgtacgaagggggaacaaaagtaagatacgagcaagcagaaacgatcaaaacgtggtttggtggggatgttcgaaagtatcttgatcgaacggtggcaccaataccttgcaataggtataggggtgtgcgagtttaccatagtgagcatatctacaggtaaagacgataagggttaaaatcccagcataccttacgtggtgtatgattgagaataataaagtctaatcagtgggggaaaggtatgtataacgttaagaaggacttagttttagggtctacgggggtattccaggtaccctttcttttattaaaggatggggaatgttcagtaaatgatgtcattgcgtgtgatttatctaataatcttctatctgatgggacattagatttagaacatttcagaaagaaaatcatttcaaggtatggatttggacacgagtcagattttgaccaggtgttggtggggtatgaagctaatctgtggtcatgggatcgtggagttgaattactgtctagggattattcgatgagtgttattaatatattcttgggggagttggcatcaaataaaaatctgatggcgctttgggatgtatttgatgtcttccgggaggcagaccatctactggatggtgacagcattaatgtgtttactgatcgagattatgttgaaggtacgtttaaggaaattgagcaggaagaattgttggcgctgcaggagtcattaggtacggattttaaaattaaagaaggtttcgttgtgtattgcaaaggaagtaaaatcattcttctggaggaggatacacaagaggtgttcctgtttagtaatgaggatgagttcaaggaattttgtacaagacgtgagttgattatcaaatttatgaggtgaattttaatggacaaagtaacgatctctcgtgaggaaagtgtttttcattcagtattaaaggttgatgggttagaagttaacgataaggtaactttacagtgggggaaaagtaatgtaacggcacgcataaacggggaaactaaggtgtcgatatttacgagtgtggtggatttaatagcttatttacactcagaaaagctgttcaaacaatcaatgcgcgatcgaggtataggtgattactttgtaggagttgattattctccgctgcacacaagggttaaagaagggcttgaagatgacgaagagagcaaataaagactaacagattcggtaatggggatgagttcaaggaattttgtctaagacgtgagtcgttaataaaaatatcgaggtgacatggcaatgggtaaagggttagtaaccaaagagcagagagtttttatttcagttttaattgtagatgaattaaaagttgatgatcaagtgaacataacttgggaaaggaatcaaattactgtaagtaggtcaggaaaggaggatatcggttttacatgtgtagttgatttaataacttttctgaattatgaaaagctctttgaccaggcaaggagaagaaaaattttaattgatgattatacaaatatgaaagggttcaccaaagaaacaagaactagggagaaggatgcattttattcggtattggcggtggatgaactaaaggtagtggaagatgtgaatatagagtggggaagggatcaactaactgtaagaagatcaggtaaagaagctgcggggtttacgggtgtagtggatctggtggcgtttctaaacactgaaaaactttttgaccaagaaacatatgatggggttttaatctacgataatcatgaaaatttaattgggataaatttatctccaatgtatgatgcaatgagcaccagtattgaaggaaacaaagaaaataacgattaacagaatagagggttatgcgtggttgtagatttggtggagttggcaaagttgtccgaagctgatttagtaaaggaattacgtaaagagaagtatcaaggcaataagtggttggttgaaggtaggataagacgactgattaatatcattaagggggatattagctgcacagagtgtacaaatagggaaagttaattctctgtggaaaggaaggcgaaaaaccaatgttaaagattgttttacatgatggtaccgagtatgctaatgatcctaagcttggtcataatttagaaacaaaagaagctatacaggaagttattgatgaggtcgggtattacgaaattttaacaaagactggttgggatcggatttataggaacgaggtaaaagaaattgtataggtggttaagggggaagtggggggcatgaagatgaggagtatagatggtaaggtggttttccgtaggggtactggcaagtgtgcgtgttgtgaaggtggtcatgtttatgagaaaaccattcagattgaaccgtactcacatccaaccgtctcggggttagaggttagatgtgtaaatgacttcataaatgaggtattggaaacatctgaggatattgaaggtaaaaaagttaaggtaactgttgaattttctgactgagggttttaatgtgcatcgcatttatttaggaatgaaagagggatcttgatggttaaattggaagactatttattgaaaacaaatgcacaattactaaatgagtttaaatggggtactcagggacaaagtgagttcaacaaatttatgaatttagtgaggaaggcgtctgatcagaaagaacatcgtggtgagatcaactgcagttataaagatcagtaagtgatttaatttaacggtgaggggagatagtatgaaaaggtttgaatatggggaaataacgactgcacaaaggagaattgacgaagaattttcctttcgaggtacgatcgcgtattctttaatgaagttactagaggatattggctcaaagggatgggagctagtcggagaagtaaaggggaagataatcgtaaaacgtgaagtagaatctgaatgaagagtgtccgataccattttattcaccggaaaagtttaaaaaatatcatgatgatttttttaataataaagattgtgttaagaactttctaaatgatgtagctataatggggggagtttttaaatgttgaggggtaggaacatcagagttattaagaaaaataatgtggagagaactacggttggtctggtttataatatctatagggattcaaaagggtatcatgttttagatgatttttgtgatgttctctatgtggatttagactgttttgatgttttgaaacattagtcggagaaattagatgaatatgtatttaattgttacgagaagtggaacttttatagctatcgggaaagatgaaagagaagcgaaggttaatttttcaaaagcctttcctaacgagaaaattagggaaatagaaaaacataaaggggagtctattcaagtttcgcatttaatgtgggacttagattaattggggattgatagtatggggaggttacggatgctgcgggctattgacgaaagggttactgagtatgtttcagatctacatagtgaagcggagagggttaaaaaagcagtgaaggatcctttatttctaataaaggatttttatttaggtagtggatccgttaagcagagaaaaatacatagtgtgttgtttgatggtgtgaaggtgcagcagaaggattttagggaacaagcattaatcaatctaaataagttttgtcgtaatattgatgatagtgttatgtgtgagtgtaggagttctcctacgggtcattatattcttaaattcgatggagtctccatcttacggtttaatattatgaaaaaggttttttctgatgcgagaatatttgaaagtgaagagcagttaagtgggactatcaaggatttaaagaataaaattaacagtttagagtgtgatctaaataagaagaggaattggcgaaaagccccgttaaaacatttaatattggggaataatcaatatcttaaaaatcccttcgtctatataaaaaatcagttaagagatacatatataggtgtgtttaaacgggtttgggttatagagcggttaaatcaaataattaaaaatgatgaaattttcatacagcaattggagtctcaaattaaagattatgaggatagaatagtgtatcttcgaaacaacaaaccgttgtgggaagaaaagtactttttctggagtcaggagtttaaaaagttggggtatgaagaagtagataaacggtctagtctagtgtattgagggtcaatcgtctgtgtctttaaaagtcaggacaattgcaatccaaattaaaacgcccagcattaaaaataaaaaggtaagaaatagccatattgggattgacatgtggatcgcccatgtacgagagtcactcttagggtgaccaaaaaatatgggaagtatacattttgatacaaatgggggataagggatcaaaaaattgctgtaaaatacgggtaactgggggtttgtatatgaaagcagataaaaaggaactactcgataagattgcaaagagtataggagatatcagaggatcgttaaagtgtgttgagcagttggaggatcagttaggtgataattacctcactatctatgacacacttcaaaaaagattacaagagaagacggagtattggaagtttgtaaataatacgtacccagatgtctttcagtatgagagtaagagaggtgttcctttactgtctcagtatacaaaggatgtgccggttcttacggtggagaattccgataagtggtatgagttgtatctaattatgccaactggtgatgtacgtgtggtcgactggaacctgcctgatttaagtgatggttggagagatcactgtattgttccaagctcgtttatggatcttgcaaggaataatggttggtacgttggttgggaagttttagacaaggtttttgaaatgtatgcagagtcgattttttaatgatacgggagttggtgtatcttatctggggatttcaaataggagaggatttcgggattgcataattttaatgagggaatagaggttaaaccattaacaggtttttggaaggggtttgttggtgtaattacagaaataaatatacaagcagatcccccaattattgttgagtttgaagatagtgagaaaaatggttattacgaaaaccaattagagatagtacaaaaataaactattgggggaagagttttgggtaaaacaatgatcgaaaatttattagcagacggtatgggtaaaagagtaaagttcaaggctatggttaagtcatgtgataaaaaagtggcatctaatcagtcaacgtatttggatttgattttatctgaccgatctggtgagattatagctaaaaagtggtcagccacagatagtgatgttcagtttttcgagagtgctaagtatatcgggatagctggggatcttggcgagtataggggaaaacctcaaatgacaatcaccaacttcaaggaacttggacaggatgaaatcgacgtttctgagtttataaaaactgcgcccgagtctgaagtgagtttaatacaggagtatgaggggttcctggacaagatttctgatgatgcgattagagagatttcttggactgtgtatagtaagtttgctgacaaatttaagattttcccggcggctaaaaaaatgcatcatgcatatattaatggcttgatttatcacacagtttctatgttaagattggcggcgcataaccataaacagtatggagatactgtgagtgttgatatggatatcgtttatggggctattgccttacatgatgttgctaaggttgttgagtatagcgatcctttccagccagagtttactgacttagggacaaaggttgggcatattgtgttggctgctatggagatcagattggcgttggaggatttaatccgtaaaaaaccggatatagatacgagtaaggtttatgatcttattcatgctgtgttagcgcatcatggtaaaaaggaatggggttctccggttgaaccgaaaacaaaagaagccggattagtacatcagatcgatttaatggatgcgactataaaccaacaaggttgaacttgatatttgttttgatggggtaggctttttccgcctacccattaattttaatgtaggtacctatctaaaccgctccaaatttacagaatttaattgtacattcttctaagggaaagtgataaaattgatgatggcgcaggggtacaccctgtgtatgtctattttaggaggattgtacatatggcagctaaggagttaaaggttatactgaaagatggggagaaagagtcttctattaccctgtctgaatttaatgaagatcatcagttagcagttatagatgggttctttaagttctttgatgtgaaggttgattttaaagagatgatagaggtatatagacggtctggcaaagaatataaagagttttatgataaattagataagcaagaggagaatagagaggatcgcgacattaagagagagtttgaggaaggatatggtactatagataaagaagataaatcagaagatgaaaaaagcgatgattataaaatcacgggaataagaatcggtaaactagggaacaaagcttataagtgcaggtataagtgtgaatgtggagataaaggtaaccattatattgagaagtatcgaaaaacagttacgtgttgggagtgtcaaagaattctagacgtgcagccggcaactgaaaacggagatccggtagatgaagataatttagaacagtaccaggatagttaccaaaacttttatgtggctgggctgcaggaacctgaatataaatttaaatagggggttgctgtgtgcaaaaagatcgggtattttcgagtgctattgacgatatggttagcgtgctgcgtgaggcggatttcggtaatctgaaagaaacagaggaaaaaatcaaccaatattttaacttattgagggttttacatagtccgttagtgttaagtgatggtggtaaagaagagaactaccctgacaagaatgaagatgttaaggggattcatgactctgattcggaaattgctgaaaaggaagaaactcagtcaaatgtaaattcttatgttttggagaggaaactaaacggcggatggttaaatgaaattaatcgatttgttcctgaaaaatacataagaaaattggacttaggagacggggacagaatatcagctgagtacatcggtaatgagcgatttcattttgagttagttgagaaaaacgaggatgcaaatcggcggtgcaagaggcgtgaaattaagtacggggtagttaaaaaagtaggtgaccggtatttagttgaggagcagcttattgacggtggaataaaaaatattaaagtaaacggggacttgtgttcttttcttctaaccgattttcatttaaatgagtttggtgatgatctggagatagaggatgggactatagtggacatagcatactgggatggggatgtaaccacgttcaaaattgtttgggtacaccctacagatactattgagtataaaaagccaaaaccctctggctattataaacaaacagagaacaagccaaaggaagatatgacaaatgatcttaaagggaaaaacgttttactgatctgtggagaaggtacagatgattcatttcgagtagccgtagagagcatgggtgggaatttcgttatgctagatgcgggtaaaccagaaagtaaagagtttatgtcacggatggaaagtaaaattaaacaagcagactatgtggtgattatggagaccaggttaagccataataagtctactagagcggcaaaatgttgtaaggattttaatattaagtttgattacttaaaggggaacggagtaggaagctttactaatttaataaaagaaatggttgatcaacaaccagttttgacctaaggatctctctttgagggatcttttatttttgattaaattgactatggattacttttgtagtaaactatatgtataaataatataaggagtgtgtagatggttggcaaaaaatcgttgtggatacgtaagaaaactaaaggacgacgggtattgggtacatatttgattattcaagtgttctatcttttgatcggttagatctatgtactaaatgattatttcggttccaaaaaatatgcagtaaaaagtttctaaggacattgaaaaggaacacatgttcgtgtattatgtaggtagaggtgttagtggtgagtgtaagtgaacaggtttttgatcggactaaaaaattaaaacgtgaaattttagggatttatactgagtctaatggtagaccggcagttaaaccgaaagtagagtgtcctctgtgcaaaaataaaacagatcactatgactgcttttgggatgtaaacaagcacattcttttttattgtgactcatgtgaatttttgatgagggaatagtgaaatgtaagggaacctttagggttcctcttttttaacttaatcgatttctatgtatttttggattgggagggtactatgaattctactttgtctagtggtgtattgggagaggttttaaacgaactaaaagataggggagttccggttagagttgaatgtgatgggtctttaaatgtggacgggatctatatgggatgcagcgtacttattagggaaagggaagaaggaaaggtcgaggttgtaacaagtaagggaaaagttagtgaattgaagtcttttcaggatttagtggatttaaactataggtggtttaaggattcaagtaaggatgattatccggatacgctttggttagagattctttttgattacggatatgttaaaaaagaaataacaacagtggtggtgtataagtagggtttattttggggggttaagtatgtataagagtatagaggttagtggaaaggttataaaaattgggttaccagattttgagggaataaagaatgggttgtatcagtatgtgtatagcaaaaatggaggtttaaacaggttgttttttcttcatggtcgttcggcggatcgatcatctgagggggaagtgaagcgtgatctagacgggatgattgattacttagatgggttaaaaaacgataagggtttccttgagtccttaattaatcagatgatttttggtggcgttgaggtgggtagtgaatccgagtatgtgttgaagtcaatgaggtactgtgtagagaaaagggtagtaaacggtgagaccgtttggaacgttccagagttagttttggtttatgttacggatagtgcgtttcaaatagtagttaggaaccaaatgtatagattgtgagtagggatatagtttcgtctagatgtgttaaattggggtagagtaaaagtttagggggattagtgtggtaaagaatgtacagtgtattaatgtagaggatgaaattaaaaagttacggaatcaaattattgttcacgatttaaggtatgctgcgggtaatccaattataactgatacggagtatgacaaactgtatgcaaaattggtcactttagagcaaaaacatccagagtacgaagatgcggagtcgccaacgaagaaaatttattcagtacttatgaaggaattaaagaaagatcagcatatgagacctatgttgtctttagaaaaatgccatacagaaaaggaaattttaaaatttttaaataggtttgatgaggatacttatacgcatgttcaggataaagaagatggtttgactatagctttaacgtatactgacggggttcttataaaggcagtaacaagaggagatggggttattggggaggatgtaactcatgcaataaaggtcttacccagtgttcccaagtttgttgacacagataaagattttgtggtgagaggagaggcaattatcccgtttaaagcatttgaaaatataaataaagatgggaaatataagtcaccaagaaatcttgtttctggatcagtccgaacgttaaaagccaatatagcccgagatcgtggagtggagttccgtgctttcgatattatgtttaaaggtaactcaggatttaatcgatacagcgatgagagagatttcttacaacaactggggtttacattatctcaaagtaaacagtttacaaatacgccagagggtaaagagcagctggttaaatattgtttagggtttgctaacagtgaaaggtctaagcgtggacatatgttggatgggttggtattaaaggcagatagggttagggatcgcgaaagattgggagagacgtctaaatatcctaagtgggcaatagcgtttaaattcgattctttagacgccacaacaaaaataacgggtgtggtttggactttgggaaagacagggcaggtaacgccaaatgcggtattggagcctgttgagattgatggggtaaagattcaaaaagcttctcttgcgaatatagctaatataagagatcgtgatatcctattaggggatacggttgttgtagcccgtgccaacgatgtaatcccacaagtggtggcgccggttaaagaattgagaacaggggaagagaaagtaattgaacaacctagtcactgccccgtttgtgatagagagcttgtaatgaagaaagatttattgttttgtataaatgaagattgctctgcgaaaacagaaagagttttacagcactttgtttctagggatgctttagatatagatggtttaggaaagaaaacaattaaaactttgtatgaactggggttaattcagaaagtggaggatatcttcacgttatatgaaaaagaagatgaacttaaagagttggatggttttggtgaggcaaaggttaaaaagatgcttgatggggtggagaaagcaaaagggaaaccaatgtctaggttaatttatggattaggtgtaaaaaatataggtcagtctgttgcgaaattgatttcaaatgagtttaaatctgttgagacgatgattaagctggcagatgagggaaaactgcgtaatagcttattggggctgcaggatgtgggtgaagtggtcgctgctagtgttgattatttatttacaaatcaacggtatcgggagctgttcttgttctttaaagaaattgggttcagtttaaatgagccagttcaacaaatcagcgaacaagtagacagaaagttggacggtaaggtatttgttattacaggggcattatcggagtccagaggagttattaaaaagaaaatcgaaaaagctggtggaaaagtgtcagggtctgtttcgaaaaatacagcataccttgttttgggagggtatgatgatataacaggtgaggcagactccacaagttctaagtataaaaaggcactgcagttgggaactgaaatcatatcagaaaataaattacaaagtatgttgaataattaatgggcaataaaaaaactcccggttcattttggactaggagttttttgtattctcatttgtttgcagtagttggatgtgacggtgataacaggaaggatcaggagggttaatagctagtgtaatatagatattaaatgaggggcgagcttttcgatacgggtaaagtggatatggggaaattcaagataaaataattttattgaaagataaaaacacaaatggcggctatattgtaactgactaatttttatttgacagtagattacttttatagtaaactgtatgtacacaacaaaaggttgtgtagagatgttggggagtagattagtcatagtcctcggggttcaggctctggggactgattaaagtaagtgtttcggctaatggacggtttacacctgtctattagcggggacatttcccgaattgttttaaacaagtttgatcacctcctttcatccgatgtggatactgtaccttgactggtgcagtatgtcggataaagagtatttttgtataagtactctttatcgggcaatgacaacttagttattgtctagtgaggaaactcacttagttgtctggtggcggaatgtgtagacgttaatcaggtataggggaacttgtcaggtattgagggcacaatccctaaacgtgctggcgagaccgagacgatcattggcgtgggtatgcgctgtattgatactaagctaggtgatgtgatcgaccgatatcgattgggttggttgcggaggacggctatcgggcaagaagtaaaacgaggcggcgctacacgcctaccctatactatgtggggttaaaatcctcacccagacattaaaggatttaacctaccatttaaagtttcggaacgtagtgtattatgtgagagacggatggttaaaattttcggaacgcagtttactgtgtgagaaattacccggcaactgccgggttcctttattttaaaaaaattgggggaattatagatggttggattaacagatgtggaagttgcagaacatataaagagtctagacgctccattctttttagatgagaaactgtttacgcttgttcggtacattgagcagggaactgtaccgggtggggaagattttgagttagaggacgtagacggaaacaagcgagtttctaatgttgacgatgcagtatgtttgggagatggtttaagccatactatggttttaactgatggcaaggttatggatggggtatccgctgtttggaattcggatctagataaagaaatggttgtagtgggtattgatgatgaagaattctttctcttaaataagagagaagttaaaaatattggtgacaatgaccttatctagttatttgtaggggtgtgaactctaacaccccttttattaattaatgggggttgtatttttgataataaatgttgttgcagctctggtgattctatatgtatacttacctgaaatgatggggtttcagtggaatcaaagttttgcaagtaggttaaggaatagagtaaataaagatacatattttaacccattaaatttgggtgtattcacaattatggcttttgggataagtataatgtgtaccttgtcggcgtacttgatagaaaatcggattgttttagttacaggtgctttagcaaccatggcgttatttcaacagggatttgagtttaaacgaagaattgagaagtctataagtgggaagctgagtaagccagaatttccaagtaagctaagtaggctatcagcttttgttataattataaatactgtggtatgtgcctggattcagataataacctacattaatatggcaccgtaatatctaaagttggaggtaagtttttatatgaattgtgtttggaaatacaaattagatcatatggttcagaaagtagagttaccggttggagctaaaatactctcagcagtcatccaagatggtcatgttgtagtctatgcttttgtgaatagcgatgaagagaaaaaggaaaccgtagagtttgttactcaatcgacaggagaaagttcggttgagcgtttaaacgagtatacgtttctcgatacggtgatgacagctaatgggttggtgtttcatattttttataaatgataattcagagagggtttaaagccctcttttttgattgttctacatataatatagtgagacaaatttgttaatgtggaagtattaatcgacggggggttcgttcggtaatggagtggaaaagaagatttggtgtggagaatgtaattataagttcggaggtagacaggtatttaatagatgcagggtttgttgtcgataagtttacacccagatttataagggattctgatgatgattggtatgaaaaaattaaaaaccatggtctaccttgcttagttttacatgagaaggatccggatgatccagaacaatatttaagattatatataaacgaagaagaggcgtatttagaggtcgagacttcatacagaagttttcacagaaattattatagggaacataacgttaaagctgttgatgaggtagacgagctgctgaatgacatgtgtaggatttaaactggttaggagtaggtagaggtaagcttagagaggggattccctctctttttttgatattgataacaaggttggattgcgcgagtaacaaatttggtaaacttaatttgctaataagggtttttaagtcgatttatgatgatttttataaaaacaaaaaataaataaaatcctttttttaaaacaaaatctgatttttatttaacaaaaggatatttaaaaagaataagtgactggggaaccttttttgattaaaatcaagaatctgaatcaacttccgatatatttgagggagttatatttttgtccaaaatcggaggttggcgagtatttgattattgattaaaaaagagataaataaaagaggataggtgttgcgagtgattcagtttagtaaaggtaaggattttggtgagaataacggttgtttaagagtagaggatgccaatgtgatatgccaaccgctcacagacaaagagaaatcggatatgatacaggtattgggtgcaatgtttaggttgtacaatttcgatttgttagtgaggtaggtgattgatgtgaaaagatgtccttattgtgaaaaagaactgggtgtattaaaggtggattctcttggtatagatgtgttgggttgtaatgattgtggttgggatgaagattctaaacaaaaagaagatgttttgtctgaaatgtcttggtatttgtaggggtgatgatgttggaagaactaaagaagtatttaaagaaaaggatggctcatgcagctaaaagagttgatgggttgaaggggaatccgaaccgtagatatgatttggggtactgggaagggaagttatcaacgtacgagggtcttttagatacaatcaaagaaatggagaaactaaaaaccggtactagttaagtgtaagaggaattaggtatagatatataaatggttttgaaaagaaaaagattgttaggttaacctatgatgtgtctgttaaggggtagggttaaataaagggagatgtagttaggtaaggttaggggtgagagtatatgtttttcatgagaatgatgattttggggttgttttcactaacagcgtttaatttaatggtgtggcaaggtattgagatggttcaagcagttagcagcttatttggtaaccaggatagttaatacatatccagtagtctataataatgggtaaataaagatacgggagtgttaaggatgggtcgattaaaaacaaaattaatctcagtttctcggagaaaagatgatttggatcagaaaattaataagttcctagaagatgaggggatcagcggcggggacttaattgatataaagtatagtgtaacaacccaaaaaggtgtatcgacagatttcattgttgattcggctttgattatttatgatggggaggatgatgattttgaggttgagtcaaacgatttttaataaacaatatgttacaccgtctactttgtttaagaagcgggaatatagcagcctatcactaaatgaacaatgggagaaagcggtacaggatgggtggaggttcgatccgctctacggtaaattttataaataagggggttctttatgggggaaatgtttttcaaaaaacagaaaccggttcatgatcttactgatgaccagttggatgaggcttttattctgtataaggaaaaggttcaggatgagttaatcaaagatcttgaaaaaacttataatttttctttagacgatgaggatacagtcgattttataaagcatgtaatagacttgggaattaaagaggggatgagtattgctttagatactcattctgttacagattattataaatcggtcaaaaacatagagacagatccacgttgtggggttgtcgtcaaagaggatgattctttttacggttgtggtgtgggtgagcattgggctacattaacggaaattattaaatcgaggtataagaatctgtacaaaccatttatagaacttacgaatataaatccgggtcttgacgagtatgggggaataacaagggttgatttagattcttttattttaaacaacttccgatttgtcggtgagggtaaaaagttactgagttatatagaggatgctgcaggataataaggatatgggggcgttatcgtggttaaggagattgggaataacgggttattaacatcgatgaagatggataatgacgtacactaccagtggttatttaattatattaatggtgcgttcgaagataatgaatatcaaagaaaagaatttgaaaatgtccttattgaaacaattgagtcagttaaacaaacaggtcaaattgaactcattaatagttggtgtggtcattttgatttattagtaacaccggagcggatacatcttatattgatacataaaagttttaagttgcctgaaatagaagaggttagtccagaatgacggatttaaagagaggtcaaagagttaaatgggttgatgacgaaagtttaggtacggtggtttgggtaacgaatcgaggctcatttaaaatactgtgggatgatggtgagagtgtggagtatacagagaatcttaggagtttaattgatatagtggaggtttaaacaatatggctacggtcagttttaattcagatttcaagctaggtacggatgccgctcaacaattaattaatgcgctggagagttcagaaccggttaaaacgagtgtaggtagtgaggtagtagtggttaagaataaagaagatattaaggagattatggatagttgcgtaaactaattatagagtttcataagcagtacttcaaaacaatcatttcgatctgtttaagttccttaattctcgtaacaatcttatatcctctatacaggctgctggtctacagtgtatggttgggtttaggtgtaatcggggttatatgtttattattgttgtatataacaagaggatacgggtaaggtggggagtattgattgaaggaacaggtaaaaaactccggaaatttcgaggagttaaagaaggtatatgatttgaacaggaagaggatttctgatctacagaaagaaaatgaaaaaatacggaagcggctacaggatgtttgttctcataaaaacgtaatgaagttggatggggaatttttagatccgtttgatgaagaagccaatacagatacatataagtgtttagattgtttagcggttataaaaagtacatgaggatctatattcgtttacaggtgggggttaggtattgtttgctcatgaaacgaaaagagagtatgcagcaagggaaaggttgtttgtaaagtgtttacgttatacggggtgtttaaagttagttgagaatcagtatagctaccaagacaagatgaggtacgattgtaagttgcgggttgttcaccctatctcatggttaatcatcatattgaatcttattacgtatgggtttaatagggagactatcagagatatcaaaaaggacttagtgttttggtaagtagtgatgtttggggtgaagagggtgccgaatagttttatgccttctgcatggaagtgtccggaatgtggagaagcaagtgaaaaatacattagttggtcagttgtaactaaatgtccaaagtgtaaagagttattatcctgggatggggaaaaggtaataacatacgatgaatggttaaagaatagtaattgatttagtctgttgggttactcgtaaatgtgggtaacctttctttatttgacaaattaatatatttaatatataataaatatataaatgataaagggatgaatgtttgatgagctgcatgtctgacaaactaaaaaagttgataaaagatcacccggattggactcaacaaaggttggccaaagaattgggaacatctcaatttaacgtacaccagctcatttataaaaacaacattgagtatagggacaaaaccataaagaagtatagtgagtcagagttaatcgctgagattaggaacttgattaagtgcaatcctagttggaaccaaaatcaaataggattaaagctgggaataccgcaatcacgggtgagttttattattagacatcacatccctgaatacgtaaaaaaatacagaggtcatgtaaacaaacattcttagttaggtaaggtaggaggttgatttagtgaggggaatggactacatagcgtgggatccaaagcataaacatttatttaaagtaagggagtggggtcaaacctcagaaggtaatgtatgggctaagagtaagcgtaatggtttccagcattggaatcctgagttttttcaatttacagggaagcgggagttcttcgaggacggtacacaaggtaaaaaagtgtatgagggttatatagtgagaggtaggtttaaaaatagggtaagtggatccggtttctcaatcgaaggagagattcagtatagtgattacttttctcagtttatgattatgtgtaatggtgtaggttatgggttaggtggaggaaatgattattaattggtagggttagagattaagggtaaaaaatactgaggagtgtgtgggttactatgaaggggttaattgaagcttggaaaagtgaaattgtctttgtaggattattttccgtattggtaggtattcttgttgtggttgtggcgaatttcggacattaatggtacataaatggttaggaaaagcagaagaaaatggtaaggtatagatacgaacaataaggtaaccgatagttgattgtttcacaatttttaataggggtgagtatgtctgtgggaagaaggatgtctattaaatcaaaatacccaacgtctgcttttgaaaaaaataaggaaaagcaaaaagaaatcagctctggacaaaaaaaggaaaaacaaaaaaggatactggaggaaataaaaaagaaaaagtccaagagtggtgatttaaacaatcacaaaaaagaaacggatgatagtgatttaaagtataaaaacttatatagggagtgtaagaaggagttaaaggcaattgaaaaaaagctgcagaataaaaatgaggaactgttaaaagaacgttcggaagtagatttaaagaatcaagaaatatctgtcttaaaggataaattgtataaaatttcagaaataaataatgatatcaaagcaaattatgagtcattgaaaaaagaaaaagatgatatggaaaaacatctgaatgaagtggttctaaacttacagatgcagctcgatgaggctaaccagggtttagaaaacagagaatacttcgataagagatttgaagatatcaaaaaagataataaaaattttcaacgaaaaattaacaggcttaaacaacaaaatacgaaaaaagatgaaaaaatcgacaagctaaaaaaagagcttgatgacttagatctaaaattatatgagcagcgtcaagtaatcgaagcgtacacagatataaatcctgattttattctccacacgcttattgaatcgttatcacctgataattataagcaatactctttagcaaatgatttgtctcggaagttacgtcggatagaaaaaggactgaggcttgcaaataagctacaaaagaatgaagatgttgatacaggaaatgagttatacgggcatttgtataaaaaatttgatgatttcttatttgttgatttggaggggaacaagtacactatagccgggaaacctaactatggggggtatatcaatgggataccggctacagcttacctagtgggtgacgatgccgtagtagttagttatgtttataggaagtatctaaaggaattcagtagggaagcagaaatttcacaaaatactaaaactaaagaaaaagaagacaaaaaagataaggatcaatttgaacctattggtgatttcagagtattaatagtatccagtcggaatggtattaagtatagggataggttaaaattacatggacttaatgctgataccgttgacgggttcgaagtaaaggcaagaacactggagttaatggacaaagctgatgttgttattttgtgtgtagacagtatgacacagacgtttaatgactatgccaaacaacaaaatgatcctaagtatcagtatatttacagagccaatgaagaaaaagttgtttcgagagtaatttatgcgaaacatatgctgggtttataaaaatagaagagaaattaagcggggaaatatggataatggttaaacagaaacccttgatctattggggttttcagttgaattgggaacataaatatggtaatataatagaggttcagtcaacaaaagtttattatcatcttcttaacggcaaaagtaaagaaactaatgagcaggactctgttctttacataaatttagagaggtctaggtacctctctatttttgttgtgaaaataaaatttcacactcttttaaatttttagaggtctttcctctatattatatatagctgtaaaaattttaattgaggtgatgagatggacaaacatttaaatggacttcaaagattcataattatggtctggggaagtgcaggaaacaaaatggcggcagggatggttgctgggggaatgggtataatcgggacgagcgtaggaacagactggattcaaatggggctgatatttctagctaagatatttaaaataaacgtggatgtggttgaggggggaagcacacttgttggtgttggtgccggagggttcttagtagcgggaggggtttggctttatttacacttaaataagaccaaaggttaccaaaaaactaaacaagttgcacggattgagcatgtttctatagaggtggctgatttttcacgaataccaaataagcaaaacgcagctactttagttcataaaattgatcaggtagatagcatgcgacacttatctgaaatgggtataaacaatgcactattcatacagaagaaaaaggttaattccgtactaaataggtatcaggacgatgatgtaaaaccagaggttgtagattactatgggttagcccatataccatttacaatccttcttgggtatcaaatagcggacaaggttaaagtcggatttcacgagtggaatcaaaacaaaggtgactgggttgagattaaaaacaaaatggaatcctaccaaaaacttatattagataaaaaccagattcaaaacccgagagatgtgagtgagattattttaaaagttgggatgactacctcagttgaagacgaccatttaagtggtttgggattagatggtttagatacgtataatcttcatttagagaacccggggcgtaatcacattgtaagtttgcagcaactacaggactataaagtaaaggtaagaggtactctcgatgaaatcaatagaacgtatccaaaccttaaaaagattcatttgttttattcgggtcaaatgtcttttgcatattgtttggggagtacgttttccccaaggatggatccacaaattcttgtttataatcatgtttttgggggttctccaagatacaattgggtactgccgcttaaaaaggcgcatgaaaatatagaagcaaaattaacccgggaggtagttgtagatgatgtatgatctgagtggtaaattcaatactttttatgccaaacacgttgtattgcagcaaaaacaaaaatccgatttatacaagaagaaggacattaatatagagaggctaaaagagggtttacaggcttataatgaggataaaggtacagattataaacttgccgaggagccggttgtacagggaagtgtaaccatgcatacggtaactcaaaatgatacaaatgattatgatattgatgtggctatagtgtttgaaaaggataacattccagaggggacaatagcagctaaacgggttgtggagcaagctttacttaaaaagtgtacaggttttaaggaaccgccaaaagcacataccaactgtgtgaggattgtatataaggatgggtatcatatagactttgcggtgtacagacgttataaacagaatgagagtgatgacgagtatacttacgaacactgcggaagtgagtggagagaacgagatccaagaaaaataacaaaatggtttgtggatcaaaacaaaaatgaacataactataagctgcgtgaggtagttcggttattgaagatgttttgtaagtctagagatacgtggacaatgcccgggggattgattcaaagtgttttggctgacgaaaagtgccaatcacaatatgatcgtacagatgagcggttttactatacgattaaagggattcgagataggttagagatctatcagggggtattcaatcctacagatactacaaaaagtctgacgtacacagataaggacaaacggaaggtaaataatctgtatattaggttagatacgtacattaaaaaactggatgttttatttgaagatggttgcacaagagaagatgcaataaacgcatggtgtgaatttttcaatcatggttactgggaagaacaaaaagaggagcaccgtggatcttctgaggttcataaggcatttagtgaggtagcggctgctgttccgtaccgggtctttactgaaacagaagagtttattgatcacttatttgcggtcaatcttaaatattcattagagatcaaatgtgaggtagcaaggaatgatcaagtaattgggactttggataattacttactgggtcgaagaggattggagtccgggttaaggttagggttcaaagcggtaacgaatgcccctgagccgtacaaaatatattggaaaacaaaaaatcgaggatctgtagctattgaccgaaacgaagtcaggggacagattttcgagggtttttatccagataatttgcttcatatcgaagagacactattcagtggtgatcattatgttgagtgctatgtggttaaagacaatatctgtgttgcaaagggacgaataaatgttcctatagtgtaaataaattggataaaaacctccttacattggaaacgaaaatggtttaacatggagaaaatcctttatacatcttagaagatcctaaagaattgttctttgggatttttctaaattttgataagtcatactattaggacatttccagtttaaaacattatggtaaaatgatgtagactatgtgagggggtttacaatgggtggtagtttgctgtcgtcggctgaggttggggttaaaataagcaagtggatgtatcatattagaaaatttaatgttgcagatgctgagatgtggaaagcagaaattaatcgtgatatggagaatgtggagtttgaccaggacttaaagttgtataagcagcttgtggattataggcatgatattatgttatcgcatgttaaacccataaatgttactagggagtatgttgatttcggggagttatctcatgaaatagagtttcaaaataaggaaatgtccgggttactacattactatgcgtacttattccgggggatgagtgaatttaggaacggaaattttgttgttgcaattacttactacaaacaggcagaaaagtacgtggttaatgttaaagatgaggcagaaaaagcagaatattattttaaattagctgaagtttattacaatatgaagcagacgtatttttccatgcactatgctgtcttggcgagagatacgtataggaatataaataactatgggaatgaagtggctaggtgtcaatttgttattgcgggtaaccttcttgatgcagaaaggcataatgaggcgttagatatatttaaagcggctttggattacataaaaagtggcggcgatcattactttcttgggttagcctattataatgtaggaatgtgtttacaccagatgggaaggttaaatgatgctttggggtatcttgatgagagtattaaaatctatcggaaagagaactctcataacctaaaaagagccttgttcactaaagcccatgtattatataagcttgatcgggatacagaggcgaatgtattatgctgcgagggtgaggagttatgcaaaaaatttgaagatgaattaacctccgcgaagtataagttcttaaaacatttatatatagagaaggagaattcatgtaaaatagaaggtgacttacggatcctggaggagaatgatcatcttgcggatgtagaggaacttgctattgatgctgcggattattatacccggatcggtaggttagaggaagccaataagctgtataaaaaatcgatcttgaccagaaaggaaattcagagagggggtattttctgtgaagattatgatggcagcggcaatgttaattttttctctaggacttagcttttctagtggaggtacggtggatatggcaggacgtgcgcatacttcgtcgattggggatatgcaactagcagatcgtgctcatacttcataactgttaaattgacatttttataataattgagtataatttttttgggagtagagtttatttatctcggaaaagcaatgcatcacgtttaagacctcggttaactccggggtctttttgatatgaacaagtgagttggacaggaagatataaggtatgatatagagaaagtaaaatatctggggggtttattaattggaagtaagtgaaggaacaaagcatggaaagatctcgtatagtgaagagcaaaaaaggaattttgcaagccagttgagggatcttattaacgagaacccggattggtcgcaaaagcagttggcggaggctgttggaatttctcaatcaactgtgtaccggttagttaaaaaatatggtattgggtatgtaaaaaagcagagggtacataaacaagaggttcagacaattagtggagatcggttaaaaaaattgatgggaaggcatcctgaatggacaattagtcagttagcttatgctataggtgtacctgatgaggtaattgtagcaactatgagaaaattcaatattgaggcaccaaaataaggagagcagtcagctctcctttagaatttttctgggttccatctagcagctacttctttttcacgttccagaactttttctaagtatctttctgttgttctccggtcttggtggtgtaatgcctgttgtatttctagtatgtcagcccccatttgtcggctataaattgcaaagaagtgtctaaaactatggggagtgatttttgattcccgatgctgtaaaaaaggtaattttgttttctcaatctctcttattacaaagttacttaaatttttattagtatagtgtttacgtttttgggttgcgaatagtgggctatcatctgtagggtctaaggatgtactcattcttcttcgctttcgaaacaacataatgcgttcaaaattgactaaatgaattaagcagtcaaaaggtttatcccccttccctactccgcgaagtctgtactgtccggttaatggatcatagtaaaggtctttcatttttgctttacttatttcctgtatacgtaatcctgtcatagctaaagtagttagaatcccgtgagttatcggattgctctcataaaaatctagaatttgcttaacttcatggtagtacagatccctattaggtatttcgtcttttgagattgctgtacttagcatgtgcgtatgtaaaggatgatctatgtaagagcattcatatagatatttaagaaagcttttaatgacagtactcttgaaatctagagtggctgcagagtatggttttccttttcgacctaaaggagccgtacttagatattcttgataagctttaatgtgtctaggacgaagattctttaataaagactcttggttaaactcggtaacatcttgaataaagaactctttattttgtttcaaataattatagaattggagaagaactctggagtattcaatcttagagtttgatgatctgtctttagattttctgacatgtttacgtttatgaacaaaataatatataactgcttcatccgttaattgatccattgtaggtttgtttaaccgctcattacttataataacatcctctaataatgacatagatgaatcatctacaataatatcagcagttaacatattttgattactgtctgatatttggttattaaatagcaccaattgattcatttaattaataacctcgcttaaaattgtatcaattaagaaatcttatacatgttgatttaaatatatagatcaattgcttaattgtgattttattataacaatatttaaagatgctttaaatgcaataatgaagataagtttatgatagacataatataatttgtagaaaaagtgcctatttgtctaaaagtcattacatgattataaaatgctataattaaataaacttttaatcatgtaatgataaaattaattgtttaactcaaattaaaaaacatcaagaatatgatatactaataatgaatattcgaattgatggagtgatgtatgttggataacaatattgaactaaatgatcataatattgaggaaaaggaatacataacaactaatgaggctatgaagatacttggagtagaatctcaacaaacaatatatcggtatgtaaataaagggatactaaaccctgttaataaggatgattggaaaattgatggtgtatatgagtttaagtatactgatgtaattgaattaaaggataacctaacacctaaagattacaccacgtctgatgttgcaaaaatactgggagttagtcagccaacagttttaaagtatattgagcaaggaattttaaaagcacacaaacgcaactttcgggggttggtgtataatttcatttctaagaatgatctgagagatttccaaataaaccataaaataggtaaacggcatactaagcaatctttttatgatcaaaatacaggatatgcattgtaccaaaagttcacacaaggaaatagtacggcgagaataatatctctaagtgatggcattaaggtcattaaagataactatgaggaggatattattaatcggattgaagatgatggttttactcctgaatatgtaatcgaaaagaaaaaagcggtaactaaggatgggtttgcaaagtttaagtttaaattgccggctgctgtagacaatcctgttttttcagtaattgatatgttttataaggagtttagtccaacaaatatgagattgaaaaaattgatggacgattatattcaaattgaggtaaagccggggttagtttcggaacaatattcaggattggttgatatgttacaatcacatataatagaaggaaaagtttcgctaagacggaacgggatttatattgatagcgatattacaccaattcgacttaaagttagtaacaaagtaaaacgtgagtttgagaaaaaagctaaacaatacgatatgagtatggatgagttaattgtagctgcggttagaaaatttgagttgtgataatgaaggagtgttttactttgtataaaattcgaggaattatgagtaatggaacggaactgaggcttacggacgacagtgaaaaagaagttgagtttacaacaactcaggaagctaacgacatgatagagcaacttaaaagaagtttgtcccgggatattgagtatcatgtagacccaataaaatagtagataaattttaagtatctgtagtacaatcattgttagacgttacgttctctttaaatattgatcgtttcggtcataaacctgtatttatgtggttacccacaaaaaagtcactctcaatgggtggctttttacgttttaaaatgggattgtataagaagaattaattggttcctgtgtgattgtggaacccaatcctttgttaaatttaaagggtcagtggattacaacgaaagatttgctcgttgtaaaagttagatctaatctttcagtttgtcaggctcaggggttagatttcttatgtaattaatgccgatcttaaatggtcggttttttgttttcttaaagttctttttcttgataagaatcaggggattagcggtctgaaagttttttataatgagtattgagatgaggattgattttttaatcttactttattaaagattttttgatttatatttaattcctgattttttaattaagtgtggtcagatagaacgtttagatcagtgtactaaatgattttaatgtttaataaaggggaaatttattttgtttaacaaaattgatttgccaaaaaaccccagaggttatttcagataaagatcattttgaaaaacataagggatttaaattaataaataatttttatcaaaaacctgtatcttcggataggtaggctattgatgggttaattgggagtttacagaacatcattttcattagttcaaaatagatgtagctcccctatttttatgtagatgaaatttgtttacgtataattagataatgaatataaaaatgatttttaatattgatattaatgaggatgtggtttaaatgaataagaggcagtggagaaagaagctttggaataccggggatacggataggtatgggttatgttttacaaaatatctgcaggatcgaatcgaccatggagattattgtgttgtgactaaaaacttcggaaaactccgaaaaattcatgtgagggagtgtaaataatatgggtattaatttagggagaatgagttatgaggaactggttgatctccgggctaaggttactatggctattgaaaagtctttatttcaatctgggtaccgagaagcgaaaaagcatgcaaggttaattaaaaagaaaaatgaactcaaaaggaatcaaaggattagagagaaaataattgtggaagcgaaggaagatgttaagcagctacttgagagaaataaacaattgaaaacgtttgatgtgtctttcgctgttcattcaagtaaagatattttaaatcgatggtcggtgatcgccacagccaagagtcataccagcaataaagaatttattgaatcagcagtttgtgctgatggggagtgttttaatatccatattggggaagcaatagcattacggagagttttggggttggaggttaaggatgtatatttgaatgttccacaaccaacagaggttaaggttggcgatactattcttacaggtggtcatgttgaaaaagtaattggttttgaggaagatggctctgtaatggttgagactggatgccttatgcattttgatcatttggatgctgataccggggatagaattttggctgattctgatgcggacaatacgtttgttctgtgggatgaggatatggtggaataaatgattgtgtataaaacaggcgatattttaatggcaactgaggacattatttgtcagcaagttaactgtaaaggagttatgggtgctggtttagcaaaacaaattcggaaaaagtaccctaagtgctttgaggactatagtttatatgttgaaaatcggggttatgatgcggatgtacttcttggaggggtacattattacaggggcaaaagtggaaaggtgattgcaaatttgtttggtcagaatgggtttgggagagaaaaacagcaaacagattacacatcactacgacgtgcttttcataatgtaaaaaataaagtcacctgtatggatgatcaagatggagggaagtcggttgctatcccctacggtataggatgtgggttggccggaggtaactgggatgttgtacaagaaattatagatgaggtatttgcagactatgaggtatccgtttataaatttaagtagtctcccctaccctgcttaataaaaatgaaattacatccgatattgataatgttgtatgaatgtgaaattaaaagcattaaggaggttaaagttgatggaggtgtgtgaattgcaaccaaaaataactttaaaaaaggcacaagagttatttgatcaagcaacgaagtatttcacagtagatcacaacaatcaacccgaggagtttatatggtattcaaaaaaggatcaagagttcagactaagggagcttcgtaacggtgttgttccaaattcaattgttgtctttagtgctgaggagatgtttgatcaatcactgaggtatgtaaacaaagagcaaacgaaaaaagactcggtgaggtacatttatgacaagatcaatcaccggttaaatctaatgcaaaaaagaaattatttatccgaagtgaattagtacggtctgttatggggtttacataaacgatggggttgtgacggtgtatggatggtgtaatggttgtggaagtatctgataatatttactcggtttgtttagaggtgtttggaagtattcatgagttaagggcggaaatagacaatacagttaggagaaaaagtattgatggattaatcttgttagatactttatttcattcaggtaatggggatgacaggttttatagtatccaagcggatcaaggcgaggttttatggagtacgttcaacatcagggtggttaaaaagagtgatggtgtaagaaagaaaatagctaaagtttttgctacacatagagatttgattgtaaactcaacattaacttctgtacaaaagagaatgttgggtgcgggaattggaatataaaaactccttgccccctcccctctttcggattaggattgatttataagaaagagtacgggagggttttttctgtctaaagataatgtaatcgagtttaaaggaagaagtaataaagcggatagtttcctggatgacaggtatattgatttcttggatcactttttcatctataaggagtttttaagtgctacggacagattaggtatagaggttaatgttactgaaggttgtgttcaggttgtgtttcctcctgaactaaatgaagatagtgtaacagttactacgggcaaggaatttattgacttggtgcattatattctagttatggatttgggggtacatttttcaacgaaaaatgattgactccctatttttatgctcgataatttttccatatcccccatctgtttatgtaataatataaaagatgtaaggttttagaagggagaaatgtcgaggatgaatcaaattaattctgcgagagtattcatcagctctacaggacaggaatctttagttgaattgcgccgcattgtagcggatcggttgtctggtgctggtcatttacctcttttgtttgaacataattttgggatgtggactaatgatttgttacgtgactgtttagctaaggttgatgaatctgatgtatttatcttatttatctccaataagtgtggatcttatacgcaggtagaccccaataaaacagttacgtatgcggaatactacagagcgagaaagggaaaaaagataatcataccgtttattgaggagcatatatttaagttctttttgaaccatattgccccacaattgcggcatcagattaattcttatgtaaaagagtatgatcgttatccggattctacatatactgttctgaaggattggtttcagcagttggagatttcaaaccctgtactttttgagcagattgaggaaacacgagtagatttatttaactgggcttttatttatgacgtgtacgttaatgagccttggacttatgttgttaaattggctaatgtggaaagagcatgtgaatttgttttagaatctttgagcggagttatccgaaaggctagtccttttttccaagattttgatggtattcaagaattattagttaatggtgatcagatgcgtgagtctttaagggcagcaaaccgatttcatgcttgtttaaaggatggaggattggatacactagaactacttgaggtgttaatgggttacatgaaaggaagagatgttccccactccaacagcccgttagatgaggatattgttaatcggttgtctgattgtgaagcgatttgtttgtacagacgtgatcaggattatttaaggctgcttgagtgtgtcggggatagtgatccaacttatgaatttatgatcaatgatgaaaattcatatgtagcagagacataccagcaaaacaacgatagtgttgagaacattttttataatgaagaaaagaaaaaattatatctcaccaaaaaacttggtgatttggttatatctttgcactatcgattactgcaggaagattggtcagaaaagcgtgttcagagttatgaaaaacaactattaactgctataatgaaagaaaggcgtcagtttgattttgcagctgatattctagggggtttattaaatgggaaaaaataaagcagtgtatattgggtcaactcctcagaatgtttcgagagaggcagaggaaactgaacttaaaaaattagaggcaaagagtaaagaaattcaaaacaatttaaagaagattaaaatggacaagggacaatttagctatacatgatttttgacaggttaacttgttagttgacttttattcgtggtaatatggggttagtaaagagtgcggcaacactctatcttttaaaaattatctttcctgatagtctattttttcacttggacactcatccgctcttttataaactggatgagtgtccttttattttcgatgaacataattattgatagtgtaaataatatcaatattgaaatcgataataatgtcaattgggttttcaatatcgaaaataacatcaaattttataatgaggtggtttaatgaaagactattacgaaattaaagaggtaagcaatcttgatactttaaataaccacataaaggacggctgggaaattattgagtcttatgctaatgaaggaaagattaagtaccatatagggttgacaaaggatactgttattgaaaatttacgtaagataatcaagttatatgaggataatgggttaaaagatgttctttttgatcgtatcggagatgaattaaatgatgatattaatgactatgaagaaacaacatatcaaccaagtttaaaccctctagtacagacatttaatttttatgaacgttgggtcaacggtaaagaaacaatgttaaaaaggaaagcaggaaaagagcgaaataatgatttagttgatcactctcttcccttttgaactgagataagttaatggatagcaatattaacattgatagtgataacaataatattggtaatgttattttaaagtcgaggagtgttttaggtatggagcgttatgtaattactttggttaaaggtagtgagagaaaaactgaaacctataatcttccggattcagttaaagaggtgtttaagcactgcaaggagaagtttgaaaaaggcggatggaaagttgaatctgttgatgaggaatcatattataaagcaaccaaaggaaagtaattattaatatcgattacaaattcaattgtaatattgattgtattagttaagtaagatgccggggagttcctcggcttttctgtaacttttatttgacaaatatataataatatagtataataaaattaacaaataaagagattagattggagataataaaatgatcgcaactgatattcttattaaattaaacacttgccagggaaagggagattatactgacacttattgtgtttatgctgctgattggtttccggtagggtatcttaatactaagtatagacaggtgaaagaaataattaaaaacaacttagaaaagaaatattgtgaaccgatggaggattttaaactgagatatataccgttaacggtgtttcataatggggaactaaaacctgaaaacattgttcaggcactattagacagagatcttattgaaccgttaaaaaatattaagggtgtatatgcggcaacagaaactttaaaaaaggagttggaagaaaacagaagacaaagacaattgaaatttattataagaacaaaccgggtcatgatgggttcctccaagtgggaacgactagagaataaaaataatgagggattaataaccttatctagcagtattgaaagatttgatagcatcggtaagagagttttagtgtaggatggtaataaactcgtcacagcgagtataaagaggcattaggctgtgagcgttccccagaagtggggaggttgcaacaaattaaggaggcatggggaaattgaataacgacttcaatgaactattattacggcaacttcaattaatgagatcatgtaacgatagtatagagcggaatataaaaattcagtgtgtcctattagttctacttggtgttgttggtttagggtttttcgcaatcatgttaatgttgattgtaaatgggtgactggggtttttacagactgggttacccgtgtatgtagtgattctataaataggtctttataaaattaattaaattatataaaattcgttggaaggcgggtcggttgagtgaagtttaaagatataaaacaatacataagaagcggtggttatgcatttgatgttggacttaggtatttacctgaaacaattaataattatattaatgaatatgggttggaattaaatccagattttcagagggggcatgtttggtcgcaggatcagcaagttaagtatctggagtatttgcttaggggaggtagatctgggatggacatatacttaaatcatcccaattggcacagtggtggagatggttggttcgtatgtgtagatgggttacagaggataacagcatgcttaaaatttataaataatgaaattaaagtatttggtcattattatagccagttcgaggatagagttcctctggggtttggtctgcgatttaatatcaatagtttaaaaactcgggcagaggtattggagtggtacatacagttaaatagtgggggaactattcatacagaggatgaaataaatagggttaggcgattattacttgatgaaaaggcttaatagttagctagtaacggctgaggatactacgagggatttagataataatattgattatactattgatatcaatagtataatcaatatggctttatacattcttgcgaggaggaatttaaaatgtttttactgcgagatactgactcaggaatagtttacaacgcacttaaaaatcctgctgcagtatttgattgtgaaagtggaacagtacataaaatcggtgagagagacaaaatgataaagtttcatgaagatatgaaatcaaagtataagcagtttgggtttgatgatattgctcaggatattaagtttatggatctgccgaaggatcaagaagaaattgataaggtatttaatatttgtgattatataaaaagactgtatcttaaaaaacaattacattaatgtaattgatagtgatgttaatattgatatttaaagatatgatgggcgggtgttaagtcaaatgagattaacatttagagacaaacttgccatattcaaactggcgaatactgcagagtctatcaggccgttaagcgccgacgaggtagtgcttttaaaagaaatttacaactcttgttctgatgaggaaaaaactaatattgaaaatgaagcggtatgcgttgtggagtatttatttagggactaataaacctggagacgtgagatttcacgtctttttgattgaggaagtaaaaaatgttgatgggttatttggtatcatatgtgtaagagatctggtgttagtgaggtgtaatggtgcaaatacatacaagcatgttagagggtaaaggtgaaggtgagtttcttccggaggatttttatttagatggtggtctttcacaaaaacaaatggatctgattgatgtcatattgaaagcaacacctaaaatgttaaaaaagcaggaagatattatacctaaatcagcagcagcactaaacagaaacagtgtgaagataacgttaaggttggcacaaatcataccggtgttgatgagctatgttaaccctcggctgtttattggggataagccgggtttggggaagactgtaatgtctgctgcttgctatagttattatagactcatgatgttaaaaaagggtttacccattaaaaaaatcttagttgttacagaaagcgtacacgtattggggtttggttcagagtggggtaattacgggattaaccttcttccgctcactaaatcaagtacaggtatagcgagagcgcttagaaatagcaatatggatgaatatgatggggtcattacgaactgggacggattaaaaacaaacgggtttctagattattatttacagcatgctgatgagtatgggtatgctgtgtttgacgagacaagcaaactgttaaaccctaagtctgttttatattcaactactgacaacattataaacaaatatcgtgggggaatacctcgggttatatttttaaacgggtcgagttttgaaaaaaatatcttcgatttttattatcagttttcaatattaaaaccgaagttgatcccaaataaaacatttcttgaaagccggtatgttgttagaggaggtcgtgagatttatacaaaagatttttctagattctcaccaaatcagcagcacgtcgtgaagagacaggtaggggaaattattgattataaaaatcaggctgaattacgggaaaggttaaagtactattatatagcccggagtaagagagactatacaaaagatcttcctgaacatagctatatccttcatggagttgagcttactgcagcacagaaaaaggttctaaatgaaaagaaaaacatctctttaataaacagccctaagacgtcagatccgaaagcgaagtttacggttcaaacatcacctaaacttaaagctgttttagagtttgctcaaaaggttgaagatgacagaccaatgatctacgtctataacaaggagtcgcagctcacgattaaaagtgaacttgaaaagatgggttatcgtacagagatactaaacggtgatgtaacggttagtgaaaaaacagacatcttaaaaaggttcaatagcggaaaactggatatgttggtatttaacgtagagaaggcaatgaatgtaccaacatccgatcgaatcattttttatgatatccccacaatgccgcagagaacgaatcaaattaagggtaggattgaccggaacaactacgacaaaaagaagttttatgatttcttctgttatcttgattctccggaaatgtccaatatcgttaggttggcgtactttagggaacaccatagtaatgagtttacaggtcaagtcgaaaatgtgtatggggcgcttgtggggcaattacaggttcattatagggaggactgtttagaagaggtcgaagagaagtttgcttggatggagaacaacaataaaacatatgaagatatacaggatgatgtagatgaaatactgggtctatcctgatggtggggtgagatgtaagtctcactccttttttatttgggtatgattgctgtaacaatcaaaatgagaaacgagtgttataagatgaggttaggttgttattaggtaaagttggatattaaaaattagcggaaataggtgagggggagattttatgaaattcaaggtaaagaaacaagtaatggttatcttctcagaaagagaggtgcgggggtacataaaaaatatagaggttaagggcagaagaaggttgtctgagttagaaaagagtattcaaaaagaggttttattgattcaaagaaaatacccaacagctaatgtgaagtggacaataggtgtagttgagcttcctgtatctgcaagtgcttagaggttgggtggttaggaaggggatttaatttgaaagagtttttaaggagtaaagccggaattgcaactttgactggagtatttggggttcttgttgctgttctggttgttattatttcggtaacgggttcacataaagcagaagcacaggtattaagcaaggcacagaaaacggtagatgcattgtttgctgatgatgaacataaagaactcgctgacgatatgaaccaagatagaattgacgctgcacgtaaggaagtaaaaaaggtaaaggatgaaaaagcacaaagccagcttacattagacattaacaatgctgaggatatgtataacacacaaatagaggcaattggtttagttgatggggttatagacagtgaaggcagattaaaagataatgttaatgaattagctataaaggatgcccgtaatgcagttgttggtgttactaaccttaaagtttatggggagttgtccgaccggttagataaagctgaaaagctgtataggcaacaggttaaaacaattgagagtgtccaaaagcttttcaaggatgaggagcataaagaattagcggacaaagtagataagaaaaagatcgaaaaggttaagaaggatgttaataaaattacgagtaaagctaaaaaagagcaattgttaaaagaagtgaagaaagcttctgatctactgaaaaagaaagaggagaagaagaaaaaagaagaagaagaaaagaaaaaacgtgaagaaaagaaaaaagccgaagagaaaaagaaagaagagttaaagaaaaaagaagaggctgagaataaagaaaaagaagaattgaaaaaacaacttgaagaaaagcaaaaagaattacagaaaaaagaggctgagttaaagaaacaaaaacaggttcaagaaaaacaagaggaacctagatcgagtgagtccaagaaaactaatcagtctgtaagtaaagcaggaaatacagtagcagacatggttccgggtttaaaaaataaaaacaaagcgataattgttacagataataagggaacaaaggctacagtatacttaatggagaaacgtaatggggtttggagtactgttgacaagtttgggtctattgtcggtaaagagggttttacccatcagtttagtgaaaactctacgggaacaccgattgggaatttttcagtagggattgcttttggtcgtaatggtaacccaggaacaaaattgacttggcataacataaagactggtgatgtgtggattgacgattctagcgacaaacgatataatacgttacagactggcgggaacggggaaaagatgaatatttcccagtatgattatggtttccaaattggttggaatctagatcggacgcctggtaaggggtctgcagtctttttccatgtatcaaacggaaagccaacattaggttgtgtttctgcaagtaaaggtaatgtaattaaaactcttaaatgggttgataaaaatacacgtattgttattgcaccacgtaatgaattaaaaaattattaattttagagacagcgtataagctgtctttttattatggttaggttgatagtaatcgaggtaacgagcgaaaggtattcgtgtacactatatatagttaagttattggggggtacgttatggcaagagattgtcgagtatgcggcggaaaagggttccgaatggagaagatcgatggatccctaagacgtgtagcctgtaaagagtgtgggggagtacgtaacttccgagataaattagaagcaagagagccatcagatagggagttggctgaatatataccgaatgcttattttagagcgattgagtttgatagagcggttttagaaaaagaaatccccgtacctatggcggtaagggacatatattttgaagtgtactatgactttatggagaaaatgatcgctacattacgaatgggtcaagtacctaaaaagagctatattgtcacagcaccagataactttgggaagaaggtgtttgtgtattctatgataaaaaacgctctaaggggaacttaaaacctacggagttaattgattctcgggatgtgtatgatcaacttgaccatcaaaattatgcccaattaaaggaatggtttaatgccgatattgcgtttatgacattgggtggtgcgccggctaagtcggatgcgatatcaatcaagactgttctggatatttgtgaacggaagggaataccgttaattgtgttgtctaggtttaacgggtcttattttacgaagtttgatagcttaatggctgcttcagtgggggtaaaagctacgaaggatggagattatggtcgactagagcagcaaggaatattcggggacacgttaaatgcagtcagggagtattacaatactcagcttggaggatccgttaaaaattataaagatgcacaaagaagagggtagaagtaggaggtaaagtatggcgttagtcattacggagcaggatatttttaaatatttggttccacatgaagatgttgatctaaatataaggtctaatactcgaataatgctgactcgtataccggttaacatattcaaggatgagtattatattttataccgggctttcgaggcagcgaacaagcacaatatttggatgggttatgagcaactacatcagatattgttgaataaccttgaggatataattgatgaccctaaagtgacactgtttgaagacgagcaactacctagaaatgaattaatggataaaatactggactatacactgcatgagtacgatgatttgtgctctttggatatcgaggatgtggataacttaaagggaaacatgcaattgtatatcgagacctgggcggttgagaaatcccgggagattactctaaataagctcgaaattttaaatgagggtaaaaaatttgggcgcattttttataagggggttgaggacgctcataactactaccaaaaggcttatgaggtagttagggcgcttttagaagcagatgcgggtaagctatctgagtcgattgatacgtcagtggacactgttgaggatattaatcggaaaatgcaggaggagactgttgcagaaccgattgcacacactggtgtagatcaaatcgacaaacagataacggcattttataaaggtgaaattgttgttattcaagcaggaactggtgtaggtaaaacacgtaaaactgtaaacatagcgtacaacgggttgaagcgtggaaaaaatgtactttatctgtccttagagcaaaaagctacacgtatatatccaatgtttttagcaaggcatattcttgagatgtatggtgatatagtcgagttaacggataaagatatcatccgaaaaacgtatagtatggtttatgagccgcagaaaactgctgcagagattgactttatccaaaatgaaaatattgggcggttaaagattgagggtcgttcgttaatggcgaatgatttatacaattatttagtacgtacatgggaagagggtttccattttgacattgtggttcttgactatctggggttattagaagttcaaggagggcgtcgttacgatgtgttaaccgaaacaattaacatgataaagtcggaggttaaatcctttaagggtaggggcttcttggcgattatacctaaccagttatccggtgaggctgaggatcagttggaaaaaggggaatacgatttattgaaaaaaggtggaagtgaaacaaagtatgtcagtagggcggcagattatgtgtacactttataccaaaatgatcgtatgaaaaaggatagtgtaatgagaattcttaatagtaaggttcgtttagggcaagcaccgcagccattttatatggctgatgttgatttgggtaaatgtgtgtttgttggacgaccagaggatgaagatgatgacgatgatctctaataagttggggtgtagtaaatggctgtagataagggacaattggagaaagctagggaaattctaattcaagagattccgctctcaaagtacattagagataatcggttagggaatgcagataatgaatcaggaaagattaattgtcctgttcatgacgatagttccccatctttttactacgatgataaccttaaaacgtgtaactgtttcgggtgtagtgttaagggttccgttgttgaattacactacgccattaagaggaagacagatgatcggtatacacaagttaaggcagtcagggacttatctttaaaatacaaggtaaagctgccaagtttatatgagcgtagtgtcgatgcaaaaccgaaacatcaacttagaccttctaaaagaagaaggcattcagatttgaacgacgaggtgatgtataaacggaagatagaaaagttagagtatcagataaagtttatagaagatgtggacactaaattaaagttatataaaataatcgatgatatgtgggaaggcaaaaaaccgtctaaaaacgtatatgagacattaaacaaccgaatcaaaaatcttagttagtggtgtagttggagggaaaatgaatgaaggacgtgagacattactatgaaataacggatcggaagaaccaacaaaaaacggttaagaggaagtctccggttttaaagagtgagattgaggaaccctgttatttatttttagatcagtcaacaagttctggttatgctgtgttcgacaataaatctcggttggtgttatcgggtgttgtacaaaaaggaaaatcctctttgcaggaatataaatatgggtttcgagatcttatacaagaattggtggatagttatggggtttcgactgtatttcatgaagaggtttatgatgccagtaacatgataacaactgaggtacttttctacataaaacatatgattcaggatattggatatttttctgagaaaatagaagttctaggcttagaccatatgaagtggaagtctgagttggctaagcccgggaaattcaataagtctggggatcacaaaaaacaagttaaggaacttgttgaaaaagtgtacccactggttgctctaactgcagaggatgaggttgatgctataggtatgggtgtttccgtccttattaaacaaaaaaggagagtaaacttttaccataccacaaggtataataaaaagctgccactgaatgagtttattttaaaggatgatttaattgaaggcagtgagaaagatacaattaaaaaactaagaaaaccattccgggatgcttatgaaattggtgggctgcatgaacttcctttagatacacgaagaaaagtggatgatctgtttcgccggtttctgtcgcatagggatgccgtggtttatattcgaatccccaaaacgtataaatactggggagtgtatttgcttcaccacaatataagcccgcaggatctgattcaagatgatcaatcgtttatccttatgtgtagccgaaaatcccgtttaaaatagatatttttatagagtgaaagtcgactaatcaacatatgtgggctttcactttttttgtgttgaaatttattcaatagccttatataaagggggctatttttaaatgactattaataatattaaagatgatattaacattgttgaggatattgatcaggatgacatttctttagaagaaatactggcacagtattcaggtgataatgctgcggatgatagtggcattgagcaaaaaacaaacggtgaaggtaatgatggtcacaatgttgatattgaaaataatagtaaagaggacaattctaaaaacgtagcggatgatgaacatcttgatgagtttagtaaaagcgaatctgacataacaaattcgaatggtgcagacagctatatcgaaaaacccatggttaataacccggacaataatgttgataatgaatttaataatgaacttgaatatgaagaggatggtgaaattgatgatgataataaattagatataactgaacgtgcaaaaaggattaaagaagctttggaggagccagaagtcgttaaaacgaatttaactgcaagtttagaggacagtgagggtaaccctattgagccaagaaaacggggaacattggctgtccaagtaattagtattgaaaatgacttaaagcaaacaaaccgggtgcgtgtgggtgaccaggatgtttatgatctgcaggagtcaattaatagatttggtttaattgaacctattcatgtggtgccatttggtgattattatttgctgctgaatggttatcgcaggttggaggcgtgtgtcaaccttggtatacggaagtcccagcgttggtagatgggacaatacccccaacaatggttaagtattatgaggctattttaaataatgtaaagccttatcggttctcagagaaattaaacatggtaagcacatccgagatacacagaaaaacgtttcttatgcagctattgaagggatactggggttaaaggctggagagttcttaaaagctttatatattgatcaaatgaaaaatgattttcctgacgtctataaacaggttgagttgggaagatgactattgagcagggttttaaaaggttgaaaaagaggttgagaaaattgaaaaagaagctgctgcagttgatcaattaaatagtggtgaactagatgaaaagttacgagacaaagatgagttggctgatttgcagattgaaaagcaaa
